United States Patent
Maier et al.

(10) Patent No.: US 12,168,767 B2
(45) Date of Patent: *Dec. 17, 2024

(54) MODIFIED DOUBLE-STRANDED RNA AGENTS

(71) Applicant: ALNYLAM PHARMACEUTICALS, INC., Cambridge, MA (US)

(72) Inventors: Martin Maier, Cambridge, MA (US); Don Foster, Cambridge, MA (US); Stuart Milstein, Cambridge, MA (US); Satya Kuchimanchi, Cambridge, MA (US); Vasant Jadhav, Cambridge, MA (US); Kallanthottathil Rajeev, Cambridge, MA (US); Muthiah Manoharan, Cambridge, MA (US); Rubina Parmar, Cambridge, MA (US)

(73) Assignee: Alnylam Pharmaceuticals, Inc., Cambridge, MA (US)

(*) Notice: Subject to any disclaimer, the term of this patent is extended or adjusted under 35 U.S.C. 154(b) by 0 days.

This patent is subject to a terminal disclaimer.

(21) Appl. No.: 18/145,238

(22) Filed: Dec. 22, 2022

(65) Prior Publication Data

US 2023/0183701 A1  Jun. 15, 2023

Related U.S. Application Data

(63) Continuation of application No. 17/941,436, filed on Sep. 9, 2022, which is a continuation of application No. 17/847,550, filed on Jun. 23, 2022, now Pat. No. 11,549,109, which is a continuation of application No. 17/523,240, filed on Nov. 10, 2021, now Pat. No. 11,427,822, which is a continuation of application No. 17/479,617, filed on Sep. 20, 2021, now abandoned, which is a continuation of application No. 16/693,683, filed on Nov. 25, 2019, now Pat. No. 11,401,517, which is a continuation of application No. 16/384,644, filed on Apr. 15, 2019, now Pat. No. 10,612,027, which is a continuation of application No. 16/272,721, filed on Feb. 11, 2019, now Pat. No. 10,612,024, which is a continuation of application No. 15/504,855, filed as application No. PCT/US2015/045407 on Aug. 14, 2015, now Pat. No. 10,233,448.

(60) Provisional application No. 62/093,919, filed on Dec. 18, 2014, provisional application No. 62/083,744, filed on Nov. 24, 2014, provisional application No. 62/039,507, filed on Aug. 20, 2014.

(51) Int. Cl.
*C07H 21/02* (2006.01)
*C12N 15/11* (2006.01)
*C12N 15/113* (2010.01)

(52) U.S. Cl.
CPC .......... *C12N 15/113* (2013.01); *C12N 15/111* (2013.01); *C12N 2310/14* (2013.01); *C12N 2310/313* (2013.01); *C12N 2310/32* (2013.01); *C12N 2310/3231* (2013.01); *C12N 2310/332* (2013.01); *C12N 2310/335* (2013.01); *C12N 2310/344* (2013.01); *C12N 2310/346* (2013.01); *C12N 2310/351* (2013.01); *C12N 2310/533* (2013.01); *C12N 2320/51* (2013.01); *C12N 2320/52* (2013.01)

(58) Field of Classification Search
CPC .................................................... C12N 15/113
See application file for complete search history.

(56) References Cited

U.S. PATENT DOCUMENTS

| | | |
|---|---|---|
| 8,546,350 B2 | 10/2013 | Bennett et al. |
| 8,618,277 B2 | 12/2013 | Beigelman et al. |
| 2010/0183704 A1 | 7/2010 | Borawski et al. |
| 2011/0039914 A1 | 2/2011 | Pavco et al. |
| 2013/0281511 A1 | 10/2013 | Bettencourt et al. |
| 2013/0323836 A1 | 12/2013 | Manoharan et al. |
| 2017/0189441 A1 | 7/2017 | Colletti et al. |

FOREIGN PATENT DOCUMENTS

| | | |
|---|---|---|
| CN | 101346393 A | 1/2009 |
| CN | 102016036 A | 1/2011 |
| CN | 103154014 A | 6/2013 |

(Continued)

OTHER PUBLICATIONS

Foster et al., "Advanced siRNA Designs Further Improve In Vivo Performance of GalNAc-siRNA Conjugates," Molecular Therapy 26(3): 707-718 (2018).

(Continued)

*Primary Examiner* — Amy Rose Hudson
(74) *Attorney, Agent, or Firm* — Jeffrey N. Townes; Cozen O'Connor

(57) ABSTRACT

One aspect of the present invention relates to double-stranded RNA (dsRNA) agent capable of inhibiting the expression of a target gene. The sense strand of the dsRNA agent comprises at least one thermally destabilizing nucleotide, and at least one said thermally destabilizing nucleotide occurring at a site opposite to the seed region (positions 2-8) of the antisense strand; and the antisense strand of the dsRNA agent comprises at least two modified nucleotides that provide the nucleotide a steric bulk that is less than or equal to the steric bulk of a 2'-OMe modification, wherein said modified nucleotides are separated by 11 nucleotides in length. Other aspects of the invention relates to pharmaceutical compositions comprising these dsRNA agents suitable for therapeutic use, and methods of inhibiting the expression of a target gene by administering these dsRNA agents, e.g., for the treatment of various disease conditions.

25 Claims, 18 Drawing Sheets
Specification includes a Sequence Listing.

(56) References Cited

FOREIGN PATENT DOCUMENTS

| WO | 2010/011895 A1 | 1/2010 |
|---|---|---|
| WO | 2011/109427 A2 | 9/2011 |
| WO | 2011/133876 A2 | 10/2011 |
| WO | 2011/139702 A2 | 11/2011 |
| WO | WO2012/135246 A2 | 10/2012 |
| WO | WO2012/177784 A2 | 12/2012 |
| WO | WO2012/177921 A2 | 12/2012 |
| WO | WO2012/177947 A2 | 12/2012 |
| WO | WO2012/177949 A2 | 12/2012 |
| WO | WO2012/178033 A2 | 12/2012 |
| WO | 2013/074974 A2 | 5/2013 |
| WO | WO2013/075035 A1 | 5/2013 |
| WO | WO2013/155204 A2 | 10/2013 |
| WO | WO2013/163430 A2 | 10/2013 |
| WO | 2014/025805 A1 | 2/2014 |
| WO | 2014/043289 A2 | 3/2014 |
| WO | 2014/043292 A1 | 3/2014 |
| WO | 2014/089313 A1 | 6/2014 |
| WO | WO2014/160129 A2 | 10/2014 |
| WO | WO2014/190137 A1 | 11/2014 |
| WO | WO2014/190157 A1 | 11/2014 |
| WO | WO2015/042564 A1 | 3/2015 |
| WO | WO2015/050990 A1 | 4/2015 |
| WO | WO2015/051318 A1 | 4/2015 |
| WO | WO2015/089368 A2 | 6/2015 |
| WO | WO2015/123264 A1 | 8/2015 |
| WO | WO2015/179724 A1 | 11/2015 |
| WO | 2019190137 A1 | 10/2019 |

OTHER PUBLICATIONS

Elbashir et al., "Functional anatomy of siRNAs for mediating efficient RNAi in *Drosophila melanogaster* embryo lysate," The EMBO Journal 23: 6877-6888 (2001).
Bass B.L., "How Does RNA Editing Affect dsRNA-mediated Gene Silencing?," Cold Spring Harbor Symposia on Quantitative Biology 71; 285-292 (2006).
Third Party Submission under 37 CFR 1.290, filed in related U.S. Appl. No. 17/479,617 on Jul. 4, 2022.
Third Party Submission under 37 CFR 1.290, filed in related U.S. Appl. No. 17/479,617 on Apr. 26, 2022.
Kibria et al., "Dual-ligand modification of PEGylated liposomes shows better cell selectivity and efficient gene delivery," Journal of Controlled Release 153: 141-148 (2011).
Amarzguioui et al., "Tolerance for mutations and chemical modifications in a siRNA," Nucleic Acids Research 31: 589-595 (2003).
Laursen et al., "Utilization of unlocked nucleic acid (UNA) to enhance siRNA performance in vitro and in vivo," Mol. BioSyst. 6: 862-870 (2010).
Zheng et al., "Single Modification at position 14 of siRNA strand abolishes its gene-silencing activity by decreasing both RISC loading and target degradation," The FASEB Journal 27: 4017-4026 (2013).
Third Party Observation Filed on Aug. 29, 2018 in Corresponding EP Application No. EP20150754100.
Third Party Observations filed in Corresponding EP Application No. 20 20 3754.5.
Hong et al., "Comprehensive analysis of sequence-specific stability of siRNA," The FASEB Journal 24: 4844-4855 (2010).
Addepalli et al., "Modulation of thermal stability can enhance the potency of siRNA", Nucleic Acids Research 38: 7320-7331 (2010).
Bramsen et al., "A large-scale chemical modification screen identifies design rules to generate siRNAs with high activity, high stability and low toxicity", Nucleic Acids Research 37: 2867-2881 (2009).
Choung et al., "Chemical modification of siRNAs to improve serum stability without loss of efficacy", Biochemical and Biophysical Research Communications 342: 919-927 (2006).
Lima et al., "Single-Stranded siRNAs Activate RNAi in Animals", Cell 150: 883-894 (2012).

5'-phosphate added by cytosolic Clp1 kinase - acts as critical anchor for Ago2 loading Schematic of Ago2 loaded siRNA 5'-vinylphosphonate

A)

B)

MODIFIED DOUBLE-STRANDED RNA AGENTS

This application is a continuation of U.S. patent application Ser. No. 17/941,436, filed Sep. 9, 2022; which is a continuation application of U.S. patent application Ser. No. 17/847,550, filed Jun. 23, 2022; which a continuation of U.S. patent application Ser. No. 17/523,240, filed Nov. 10, 2021, now U.S. Pat. No. 11,427,822; which is a continuation of U.S. patent application Ser. No. 17/479,617, filed Sep. 20, 2021; which is a continuation of U.S. patent application Ser. No. 16/693,683, filed Nov. 25, 2019, now U.S. Pat. No. 11,401,517; which is continuation of U.S. patent application Ser. No. 16/384,644, filed Apr. 15, 2019, now U.S. Pat. No. 10,612,027; which is a continuation of U.S. patent application Ser. No. 16/272,721, filed Feb. 11, 2019, now U.S. Pat. No. 10,612,024; which is a continuation of U.S. patent application Ser. No. 15/504,855, filed Feb. 17, 2017, now U.S. Pat. No. 10,233,448; which is a 371 National Stage application of International PCT Application No. PCT/US2015/045407, filed Aug. 14, 2015; which claims benefit of priority to U.S. Provisional Application No. 62/093,919, filed Dec. 18, 2014; U.S. Provisional Application No. 62/083,744, filed Nov. 24, 2014; and U.S. Provisional Application No. 62/039,507, filed Aug. 20, 2014; all of which are herein incorporated by reference in their entirety.

SEQUENCE LISTING

The instant application contains a Sequence Listing which has been submitted via the USPTO patent electronic filing system in XML format and is hereby incorporated by reference in its entirety. Said XML copy, created on Nov. 14, 2022, is named 29520_1351_US_CON7_Sequence_Listing.xml and is 6,252,143 bytes in size.

FIELD OF THE INVENTION

The invention relates to RNAi duplex agents having particular motifs that are advantageous for inhibition of target gene expression, as well as RNAi compositions suitable for therapeutic use. Additionally, the invention provides methods of inhibiting the expression of a target gene by administering these RNAi duplex agents, e.g., for the treatment of various diseases.

BACKGROUND

RNA interference or "RNAi" is a term initially coined by Fire and co-workers to describe the observation that double-stranded RNA (dsRNA) can block gene expression (Fire et al. (1998) *Nature* 391, 806-811; Elbashir et al. (2001) *Genes Dev.* 15, 188-200). Short dsRNA directs gene-specific, post-transcriptional silencing in many organisms, including vertebrates, and has provided a new tool for studying gene function. RNAi is mediated by RNA-induced silencing complex (RISC), a sequence-specific, multi-component nuclease that destroys messenger RNAs homologous to the silencing trigger. RISC is known to contain short RNAs (approximately 22 nucleotides) derived from the double-stranded RNA trigger, but the protein components of this activity remained unknown.

Double-stranded RNA (dsRNA) molecules with good gene-silencing properties are needed for drug development based on RNA interference (RNAi). An initial step in RNAi is the activation of the RNA induced silencing complex (RISC), which requires degradation of the sense strand of the dsRNA duplex. Sense strand was known to act as the first RISC substrate that is cleaved by Argonaute 2 in the middle of the duplex region. Immediately after the cleaved 5'-end and 3'-end fragments of the sense strand are removed from the endonuclease Ago2, the RISC becomes activated by the antisense strand (Rand et al. (2005) *Cell* 123, 621).

It was believed that when the cleavage of the sense strand is inhibited, the endonucleolytic cleavage of target mRNA is impaired (Leuschner et al. (2006) *EMBO Rep.*, 7, 314; Rand et al. (2005) Cell 123, 621; Schwarz et al. (2004) *Curr. Biol.* 14, 787). Leuschner et al. showed that incorporation of a 2'-O-Me ribose to the Ago2 cleavage site in the sense strand inhibits RNAi in HeLa cells (Leuschner et al. (2006) *EMBO Rep.*, 7, 314). A similar effect was observed with phosphorothioate modifications, showing that cleavage of the sense strand was required for efficient RNAi also in mammals.

Morrissey et al. used a siRNA duplex containing 2'-F modified residues, among other sites and modifications, also at the Ago2 cleavage site, and obtained compatible silencing compared to the unmodified siRNAs (Morrissey et al. (2005) *Hepatology* 41, 1349). However, Morrissey's modification is not motif specific, e.g., one modification includes 2'-F modifications on all pyrimidines on both sense and antisense strands as long as pyrimidine residue is present, without any selectivity; and hence it is uncertain, based on these teachings, if specific motif modification at the cleavage site of sense strand can have any actual effect on gene silencing activity.

Muhonen et al. used a siRNA duplex containing two 2'-F modified residues at the Ago2 cleavage site on the sense or antisense strand and found it was tolerated (Muhonen et al. (2007) *Chemistry & Biodiversity* 4, 858-873). However, Muhonen's modification is also sequence specific, e.g., for each particular strand, Muhonen only modifies either all pyrimidines or all purines, without any selectivity.

Choung et al. used a siRNA duplex containing alternative modifications by 2'-OMe or various combinations of 2'-F, 2'-OMe and phosphorothioate modifications to stabilize siRNA in serum to Sur10058 (Choung et al. (2006) *Biochemical and Biophysical Research Communications* 342, 919-927). Choung suggested that the residues at the cleavage site of the antisense strand should not be modified with 2'-OMe in order to increase the stability of the siRNA.

There is thus an ongoing need for iRNA duplex agents to improve the gene silencing efficacy of siRNA gene therapeutics. This invention is directed to that need.

SUMMARY

This invention provides effective nucleotide or chemical motifs for dsRNA agents optionally conjugated to at least one ligand, which are advantageous for inhibition of target gene expression, as well as RNAi compositions suitable for therapeutic use.

In one aspect, the invention relates to a double-stranded RNA (dsRNA) agent for inhibiting the expression of a target gene. The dsRNA agent comprises a sense strand and an antisense strand, each strand having 14 to 40 nucleotides.

The dsRNA agent is represented by formula (I):

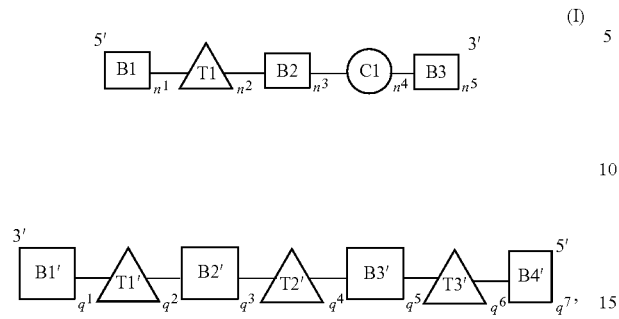

(I)

In formula (I), B1, B2, B3, B1', B2', B3', and B4' each are independently a nucleotide containing a modification selected from the group consisting of 2'-O-alkyl, 2'-substituted alkoxy, 2'-substituted alkyl, 2'-halo, ENA, and BNA/LNA. In one embodiment, B1, B2, B3, B1', B2', B3', and B4' each contain 2'-OMe modifications. In one embodiment, B1, B2, B3, B1', B2', B3', and B4' each contain 2'-OMe or 2'-F modifications. In one embodiment, at least one of B1, B2, B3, B1', B2', B3', and B4' contain 2'-O—N-methylacetamido (2'-O—NMA) modification.

C1 is a thermally destabilizing nucleotide placed at a site opposite to the seed region of the antisense strand (i.e., at positions 2-8 of the 5'-end of the antisense strand). For example, C1 is at a position of the sense strand that pairs with a nucleotide at positions 2-8 of the 5'-end of the antisense strand. In one example, C1 is at position 15 from the 5'-end of the sense strand. C1 nucleotide bears the thermally destabilizing modification which can include abasic modification; mismatch with the opposing nucleotide in the duplex; and sugar modification such as 2'-deoxy modification or acyclic nucleotide e.g., unlocked nucleic acids (UNA) or glycerol nucleic acid (GNA). In one embodiment, C1 has thermally destabilizing modification selected from the group consisting of: i) mismatch with the opposing nucleotide in the antisense strand; ii) abasic modification selected from the group consisting of:

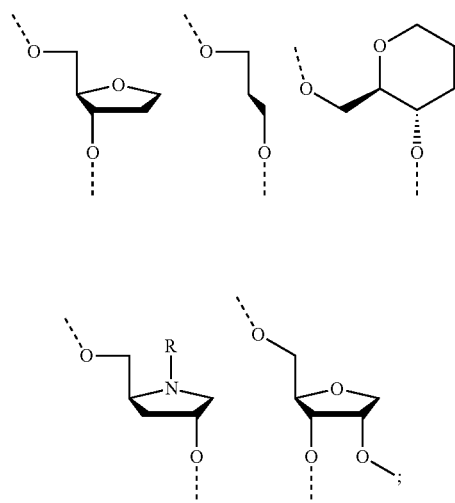

and iii) sugar modification selected from the group consisting of:

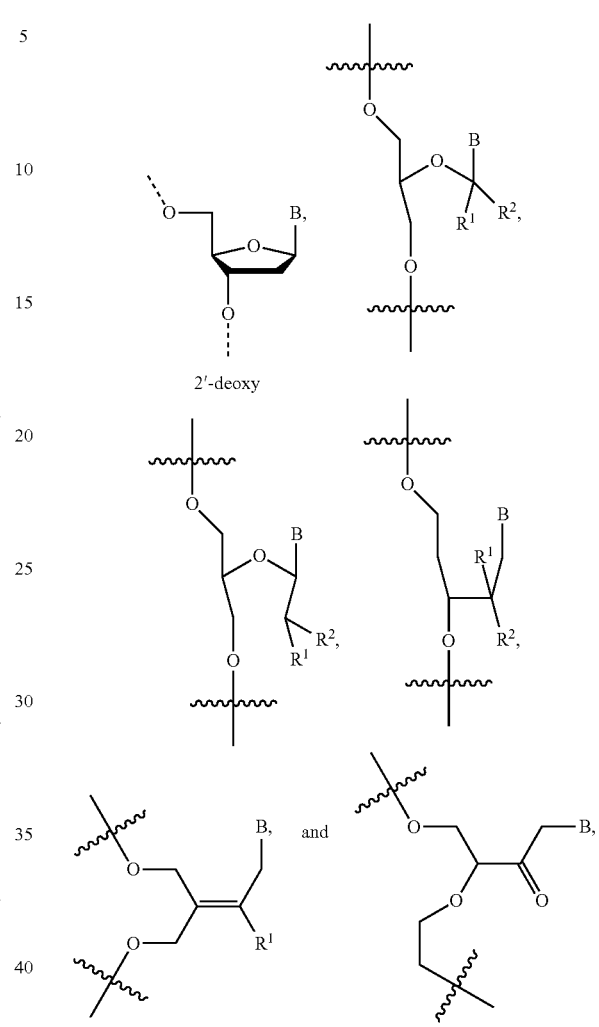

wherein B is a modified or unmodified nucleobase, $R^1$ and $R^2$ independently are H, halogen, $OR_3$, or alkyl; and $R_3$ is H, alkyl, cycloalkyl, aryl, aralkyl, heteroaryl or sugar. In one embodiment, the thermally destabilizing modification in C1 is a mismatch selected from the group consisting of G:G, G:A, G:U, G:T, A:A, A:C, C:C, C:U, C:T, U:U, T:T, and U:T; and optionally, at least one nucleobase in the mismatch pair is a 2'-deoxy nucleobase. In one example, the thermally destabilizing modification in C1 is GNA or T1, T1', T2', and T3' each independently represent a nucleotide comprising a modification providing the nucleotide a steric bulk that is less or equal to the steric bulk of a 2'-OMe modification. A steric bulk refers to the sum of steric effects of a modification. Methods for determining steric effects of a modification of a nucleotide are known to one skilled in the art. The modification can be at the 2' position of a ribose sugar of the nucleotide, or a modification to a non-ribose nucleotide, acyclic nucleotide, or the backbone of the nucleotide that is similar or equivalent to the 2' position of the ribose sugar, and provides the nucleotide a steric bulk that is less than or equal to the steric bulk of a 2'-OMe modification. For example, T1, T1', T2', and T3' are each independently selected from DNA, RNA, LNA, 2'-F, and 2'-F-5'-methyl. In one embodiment, T1 is DNA. In one embodiment, T1' is DNA, RNA or LNA. In one embodiment, T2' is DNA or RNA. In one embodiment, T3' is DNA or RNA.

$n^1$, $n^3$, and $q^1$ are independently 4 to 15 nucleotides in length.

$n^5$, $q^3$, and $q^7$ are independently 1-6 nucleotide(s) in length.

$n^4$, $q^2$, and $q^6$ are independently 1-3 nucleotide(s) in length; alternatively, $n^4$ is 0.

$q^5$ is independently 0-10 nucleotide(s) in length.

$n^2$ and $q^4$ are independently 0-3 nucleotide(s) in length.

Alternatively, $n^4$ is 0-3 nucleotide(s) in length.

In one embodiment, $n^4$ can be 0. In one example, $n^4$ is 0, and $q^2$ and $q^6$ are 1. In another example, $n^4$ is 0, and $q^2$ and $q^6$ are 1, with two phosphorothioate internucleotide linkage modifications within position 1-5 of the sense strand (counting from the 5'-end of the sense strand), and two phosphorothioate internucleotide linkage modifications at positions 1 and 2 and two phosphorothioate internucleotide linkage modifications within positions 18-23 of the antisense strand (counting from the 5'-end of the antisense strand).

In one embodiment, $n^4$, $q^2$, and $q^6$ are each 1.

In one embodiment, $n^2$, $n^4$, $q^2$, $q^4$, and $q^6$ are each 1.

In one embodiment, C1 is at position 14-17 of the 5'-end of the sense strand, when the sense strand is 19-22 nucleotides in length, and $n^4$ is 1. In one embodiment, C1 is at position 15 of the 5'-end of the sense strand In one embodiment, T3' starts at position 2 from the 5' end of the antisense strand. In one example, T3' is at position 2 from the 5' end of the antisense strand and $q^6$ is equal to 1.

In one embodiment, T1' starts at position 14 from the 5' end of the antisense strand. In one example, T1' is at position 14 from the 5' end of the antisense strand and $q^2$ is equal to 1.

In an exemplary embodiment, T3' starts from position 2 from the 5' end of the antisense strand and T1' starts from position 14 from the 5' end of the antisense strand. In one example, T3' starts from position 2 from the 5' end of the antisense strand and $q^6$ is equal to 1 and T1' starts from position 14 from the 5' end of the antisense strand and $q^2$ is equal to 1.

In one embodiment, T1' and T3' are separated by 11 nucleotides in length (i.e. not counting the T1' and T3' nucleotides).

In one embodiment, T1' is at position 14 from the 5' end of the antisense strand. In one example, T1' is at position 14 from the 5' end of the antisense strand and $q^2$ is equal to 1, and the modification at the 2' position or positions in a non-ribose, acyclic or backbone that provide less steric bulk than a 2'-OMe ribose.

In one embodiment, T3' is at position 2 from the 5' end of the antisense strand. In one example, T3' is at position 2 from the 5' end of the antisense strand and $q^6$ is equal to 1, and the modification at the 2' position or positions in a non-ribose, acyclic or backbone that provide less than or equal to steric bulk than a 2'-OMe ribose.

In one embodiment, T1 is at the cleavage site of the sense strand. In one example, T1 is at position 11 from the 5' end of the sense strand, when the sense strand is 19-22 nucleotides in length, and $n^2$ is 1. In an exemplary embodiment, T1 is at the cleavage site of the sense strand at position 11 from the 5' end of the sense strand, when the sense strand is 19-22 nucleotides in length, and $n^2$ is 1, In one embodiment, T2' starts at position 6 from the 5' end of the antisense strand. In one example, T2' is at positions 6-10 from the 5' end of the antisense strand, and $q^4$ is 1.

In an exemplary embodiment, T1 is at the cleavage site of the sense strand, for instance, at position 11 from the 5' end of the sense strand, when the sense strand is 19-22 nucleotides in length, and $n^2$ is 1; T1' is at position 14 from the 5' end of the antisense strand, and $q^2$ is equal to 1, and the modification to T1' is at the 2' position of a ribose sugar or at positions in a non-ribose, acyclic or backbone that provide less steric bulk than a 2'-OMe ribose; T2' is at positions 6-10 from the 5' end of the antisense strand, and $q^4$ is 1; and T3' is at position 2 from the 5' end of the antisense strand, and $q^6$ is equal to 1, and the modification to T3' is at the 2' position or at positions in a non-ribose, acyclic or backbone that provide less than or equal to steric bulk than a 2'-OMe ribose.

In one embodiment, T2' starts at position 8 from the 5' end of the antisense strand. In one example, T2' starts at position 8 from the 5' end of the antisense strand, and $q^4$ is 2.

In one embodiment, T2' starts at position 9 from the 5' end of the antisense strand. In one example, T2' is at position 9 from the 5' end of the antisense strand, and $q^4$ is 1.

In one embodiment, B1' is 2'-OMe or 2'-F, $q^1$ is 9, T1' is 2'-F, $q^2$ is 1, B2' is 2'-OMe or 2'-F, $q^3$ is 4, T2' is 2'-F, $q^4$ is 1, B3' is 2'-OMe or 2'-F, $q^5$ is 6, T3' is 2'-F, $q^6$ is 1, B4' is 2'-OMe, and $q^7$ is 1; with two phosphorothioate internucleotide linkage modifications within positions 1-5 of the sense strand (counting from the 5'-end of the sense strand), and two phosphorothioate internucleotide linkage modifications at positions 1 and 2 and two phosphorothioate internucleotide linkage modifications within positions 18-23 of the antisense strand (counting from the 5'-end of the antisense strand).

In one embodiment, $n^4$ is 0, B3 is 2'-OMe, $n^5$ is 3, B1' is 2'-OMe or 2'-F, $q^1$ is 9, T1' is 2'-F, $q^2$ is 1, B2' is 2'-OMe or 2'-F, $q^3$ is 4, T2' is 2'-F, $q^4$ is 1, B3' is 2'-OMe or 2'-F, $q^5$ is 6, T3' is 2'-F, $q^6$ is 1, B4' is 2'-OMe, and $q^7$ is 1; with two phosphorothioate internucleotide linkage modifications within positions 1-5 of the sense strand (counting from the 5'-end of the sense strand), and two phosphorothioate internucleotide linkage modifications at positions 1 and 2 and two phosphorothioate internucleotide linkage modifications within positions 18-23 of the antisense strand (counting from the 5'-end of the antisense strand).

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'OMe, $n^5$ is 3, B1' is 2'-OMe or 2'-F, $q^1$ is 9, T1' is 2'-F, $q^2$ is 1, B2' is 2'-OMe or 2'-F, $q^3$ is 4, T2' is 2'-F, $q^4$ is 2, B3' is 2'-OMe or 2'-F, $q^5$ is 5, T3' is 2'-F, $q^6$ is 1, B4' is 2'-OMe, and $q^7$ is 1.

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, B1' is 2'-OMe or 2'-F, $q^1$ is 9, T1' is 2'-F, $q^2$ is 1, B2' is 2'-OMe or 2'-F, $q^3$ is 4, T2' is 2'-F, $q^4$ is 2, B3' is 2'-OMe or 2'-F, $q^5$ is 5, T3' is 2'-F, $q^6$ is 1, B4' is 2'-OMe, and $q^7$ is 1; with two phosphorothioate internucleotide linkage modifications within positions 1-5 of the sense strand (counting from the 5'-end of the sense strand), and two phosphorothioate internucleotide linkage modifications at positions 1 and 2 and two phosphorothioate internucleotide linkage modifications within positions 18-23 of the antisense strand (counting from the 5'-end of the antisense strand).

In one embodiment, B1 is 2'-OMe or 2'-F, $n^1$ is 6, T1 is 2'F, $n^2$ is 3, B2 is 2'-OMe, $n^3$ is 7, $n^4$ is 0, B3 is 2'OMe, $n^5$ is 3, B1' is 2'-OMe or 2'-F, $q^1$ is 7, T1' is 2'-F, $q^2$ is 1, B2' is 2'-OMe or 2'-F, $q^3$ is 4, T2' is 2'-F, $q^4$ is 2, B3' is 2'-OMe or 2'-F, $q^5$ is 5, T3' is 2'-F, $q^6$ is 1, B4' is 2'-OMe, and $q^7$ is 1.

In one embodiment, B1 is 2'-OMe or 2'-F, $n^1$ is 6, T1 is 2'F, $n^2$ is 3, B2 is 2'-OMe, $n^3$ is 7, $n^4$ is 0, B3 is 2'-OMe, $n^5$ is 3, B1' is 2'-OMe or 2'-F, $q^1$ is 7, T1' is 2'-F, $q^2$ is 1, B2' is 2'-OMe or 2'-F, $q^3$ is 4, T2' is 2'-F, $q^4$ is 2, B3' is 2'-OMe or 2'-F, $q^5$ is 5, T3' is 2'-F, $q^6$ is 1, B4' is 2'-OMe, and $q^7$ is 1; with two phosphorothioate internucleotide linkage modifications within positions 1-5 of the sense strand (counting from the 5'-end of the sense strand), and two phosphorothioate internucleotide linkage modifications at positions 1 and 2 and two phosphorothioate internucleotide linkage modifications within positions 18-23 of the antisense strand (counting from the 5'-end of the antisense strand).

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'OMe, $n^5$ is 3, B1' is 2'-OMe or 2'-F, $q^1$ is 9, T1' is 2'-F, $q^2$ is 1, B2' is 2'-OMe or 2'-F, $q^3$ is 4, T2' is 2'-F, $q^4$ is 1, B3' is 2'-OMe or 2'-F, $q^5$ is 6, T3' is 2'-F, $q^6$ is 1, B4' is 2'-OMe, and $q^7$ is 1.

In one embodiment, B1 is 2'-OMe or 2'-F, $n^1$ is 8, T1 is 2'F, $n^2$ is 3, B2 is 2'-OMe, $n^3$ is7, $n^4$ is 0, B3 is 2'-OMe, $n^5$ is 3, B1' is 2'-OMe or 2'-F, $q^1$ is 9, T1' is 2'-F, $q^2$ is 1, B2' is 2'-OMe or 2'-F, $q^3$ is 4, T2' is 2'-F, $q^4$ is 1, B3' is 2'-OMe or 2'-F, $q^5$ is 6, T3' is 2'-F, $q^6$ is 1, B4' is 2'-OMe, and $q^7$ is 1; with two phosphorothioate internucleotide linkage modifications within positions 1-5 of the sense strand (counting from the 5'-end of the sense strand), and two phosphorothioate internucleotide linkage modifications at positions 1 and 2 and two phosphorothioate internucleotide linkage modifications within positions 18-23 of the antisense strand (counting from the 5'-end of the antisense strand).

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'OMe, $n^5$ is 3, B1' is 2'-OMe or 2'-F, $q^1$ is 9, T1' is 2'-F, $q^2$ is 1, B2' is 2'-OMe or 2'-F, $q^3$ is 5, T2' is 2'-F, $q^4$ is 1, B3' is 2'-OMe or 2'-F, $q^5$ is 5, T3' is 2'-F, $q^6$ is 1, B4' is 2'-OMe, and $q^7$ is 1; optionally with at least 2 additional TT at the 3'-end of the antisense strand.

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, B1' is 2'-OMe or 2'-F, $q^1$ is 9, T1' is 2'-F, $q^2$ is 1, B2' is 2'-OMe or 2'-F, $q^3$ is 5, T2' is 2'-F, $q^4$ is 1, B3' is 2'-OMe or 2'-F, $q^5$ is 5, T3' is 2'-F, $q^6$ is 1, B4' is 2'-OMe, and $q^7$ is 1; optionally with at least 2 additional TT at the 3'-end of the antisense strand; with two phosphorothioate internucleotide linkage modifications within positions 1-5 of the sense strand (counting from the 5'-end of the sense strand), and two phosphorothioate internucleotide linkage modifications at positions 1 and 2 and two phosphorothioate internucleotide linkage modifications within positions 18-23 of the antisense strand (counting from the 5'-end of the antisense strand).

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, B1' is 2'-OMe or 2'-F, $q^1$ is 9, T1' is 2'-F, $q^2$ is 1, B2' is 2'-OMe or 2'-F, $q^3$ is 4, $q^4$ is 0, B3' is 2'-OMe or 2'-F, $q^5$ is 7, T3' is 2'-F, $q^6$ is 1, B4' is 2'-OMe, and $q^7$ is 1.

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, B1' is 2'-OMe or 2'-F, $q^1$ is 9, T1' is 2'-F, $q^2$ is 1, B2' is 2'-OMe or 2'-F, $q^3$ is 4, $q^4$ is 0, B3' is 2'-OMe or 2'-F, $q^5$ is 7, T3' is 2'-F, $q^6$ is 1, B4' is 2'-OMe, and $q^7$ is 1; with two phosphorothioate internucleotide linkage modifications within positions 1-5 of the sense strand (counting from the 5'-end), and two phosphorothioate internucleotide linkage modifications at positions 1 and 2 and two phosphorothioate internucleotide linkage modifications within positions 18-23 of the antisense strand (counting from the 5'-end).

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'OMe, $n^5$ is 3, B1' is 2'-OMe or 2'-F, $q^1$ is 9, T1' is 2'-F, $q^2$ is 1, B2' is 2'-OMe or 2'-F, $q^3$ is 4, T2' is 2'-F, $q^4$ is 2, B3' is 2'-OMe or 2'-F, $q^5$ is 5, T3' is 2'-F, $q^6$ is 1, B4' is 2'-F, and $q^7$ is 1.

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, B1' is 2'-OMe or 2'-F, $q^1$ is 9, T1' is 2'-F, $q^2$ is 1, B2' is 2'-OMe or 2'-F, $q^3$ is 4, T2' is 2'-F, $q^4$ is 2, B3' is 2'-OMe or 2'-F, $q^5$ is 5, T3' is 2'-F, $q^6$ is 1, B4' is 2'-F, and $q^7$ is 1; with two phosphorothioate internucleotide linkage modifications within positions 1-5 of the sense strand (counting from the 5'-end of the sense strand), and two phosphorothioate internucleotide linkage modifications at positions 1 and 2 and two phosphorothioate internucleotide linkage modifications within positions 18-23 of the antisense strand (counting from the 5'-end of the antisense strand).

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, B1' is 2'-OMe or 2'-F, $q^1$ is 9, T1' is 2'-F, $q^2$ is 1, B2' is 2'-OMe or 2'-F, $q^3$ is 4, $q^4$ is 0, B3' is 2'-OMe or 2'-F, $q^5$ is 7, T3' is 2'-F, $q^6$ is 1, B4' is 2'-F, and $q^7$ is 1.

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, B1' is 2'-OMe or 2'-F, $q^1$ is 9, T1' is 2'-F, $q^2$ is 1, B2' is 2'-OMe or 2'-F, $q^3$ is 4, $q^4$ is 0, B3' is 2'-OMe or 2'-F, $q^5$ is 7, T3' is 2'-F, $q^6$ is 1, B4' is 2'-F, and $q^7$ is 1; with two phosphorothioate internucleotide linkage modifications within positions 1-5 of the sense strand (counting from the 5'-end of the sense strand), and two phosphorothioate internucleotide linkage modifications at positions 1 and 2 and two phosphorothioate internucleotide linkage modifications within positions 18-23 of the antisense strand (counting from the 5'-end of the antisense strand).

The dsRNA agent can comprise a phosphorus-containing group at the 5'-end of the sense strand or antisense strand. The 5'-end phosphorus-containing group can be 5'-end phosphate (5'-P), 5'-end phosphorothioate (5'-PS), 5'-end phosphorodithioate (5'-$PS_2$), 5'-end vinylphosphonate (5'-VP), 5'-end methylphosphonate (MePhos), or 5'-deoxy-5'—C-malonyl When the 5'-end phosphorus-containing group is 5'-end vinylphosphonate (5'-VP), the 5'-VP can be either 5'-E-VP isomer (i.e., trans-vinylphosphate,

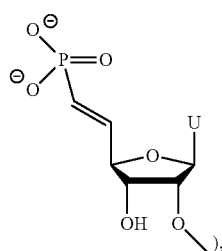

5'-Z-VP isomer (i.e., cis-vinylphosphate,

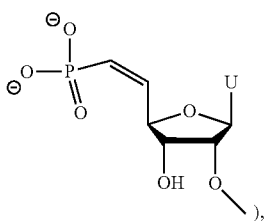

or mixtures thereof.

In one embodiment, the dsRNA agent comprises a phosphorus-containing group at the 5'-end of the sense strand. In one embodiment, the dsRNA agent comprises a phosphorus-containing group at the 5'-end of the antisense strand.

In one embodiment, the dsRNA agent comprises a 5'-P. In one embodiment, the dsRNA agent comprises a 5'-P in the antisense strand.

In one embodiment, the dsRNA agent comprises a 5'-PS. In one embodiment, the dsRNA agent comprises a 5'-PS in the antisense strand.

In one embodiment, the dsRNA agent comprises a 5'-VP. In one embodiment, the dsRNA agent comprises a 5'-VP in the antisense strand. In one embodiment, the dsRNA agent comprises a 5'-E-VP in the antisense strand. In one embodiment, the dsRNA agent comprises a 5'-Z-VP in the antisense strand.

In one embodiment, the dsRNA agent comprises a 5'-$PS_2$. In one embodiment, the dsRNA agent comprises a 5'-$PS_2$ in the antisense strand.

In one embodiment, the dsRNA agent comprises a 5'-$PS_2$. In one embodiment, the dsRNA agent comprises a 5'-deoxy-5'—C-malonyl in the antisense strand.

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'OMe, $n^5$ is 3, B1' is 2'-OMe or 2'-F, $q^1$ is 9, T1' is 2'-F, $q^2$ is 1, B2' is 2'-OMe or 2'-F, $q^3$ is 4, T2' is 2'-F, $q^4$ is 2, B3' is 2'-OMe or 2'-F, $q^5$ is 5, T3' is 2'-F, $q^6$ is 1, B4' is 2'-OMe, and $q^7$ is 1. The dsRNA agent also comprises a 5'-PS.

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'OMe, $n^5$ is 3, B1' is 2'-OMe or 2'-F, $q^1$ is 9, T1' is 2'-F, $q^2$ is 1, B2' is 2'-OMe or 2'-F, $q^3$ is 4, T2' is 2'-F, $q^4$ is 2, B3' is 2'-OMe or 2'-F, $q^5$ is 5, T3' is 2'-F, $q^6$ is 1, B4' is 2'-OMe, and $q^7$ is 1. The dsRNA agent also comprises a 5'-P.

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'OMe, $n^5$ is 3, B1' is 2'-OMe or 2'-F, $q^1$ is 9, T1' is 2'-F, $q^2$ is 1, B2' is 2'-OMe or 2'-F, $q^3$ is 4, T2' is 2'-F, $q^4$ is 2, B3' is 2'-OMe or 2'-F, $q^5$ is 5, T3' is 2'-F, $q^6$ is 1, B4' is 2'-OMe, and $q^7$ is 1. The dsRNA agent also comprises a 5'-VP. The 5'-VP may be 5'-E-VP, 5'-Z-VP, or combination thereof.

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'OMe, $n^5$ is 3, B1' is 2'-OMe or 2'-F, $q^1$ is 9, T1' is 2'-F, $q^2$ is 1, B2' is 2'-OMe or 2'-F, $q^3$ is 4, T2' is 2'-F, $q^4$ is 2, B3' is 2'-OMe or 2'-F, $q^5$ is 5, T3' is 2'-F, $q^6$ is 1, B4' is 2'-OMe, and $q^7$ is 1. The dsRNA agent also comprises a 5'-$PS_2$.

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'OMe, $n^5$ is 3, B1' is 2'-OMe or 2'-F, $q^1$ is 9, T1' is 2'-F, $q^2$ is 1, B2' is 2'-OMe or 2'-F, $q^3$ is 4, T2' is 2'-F, $q^4$ is 2, B3' is 2'-OMe or 2'-F, $q^5$ is 5, T3' is 2'-F, $q^6$ is 1, B4' is 2'-OMe, and $q^7$ is 1. The dsRNA agent also comprises a 5'-deoxy-5'—C-malonyl.

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, B1' is 2'-OMe or 2'-F, $q^1$ is 9, T1' is 2'-F, $q^2$ is 1, B2' is 2'-OMe or 2'-F, $q^3$ is 4, T2' is 2'-F, $q^4$ is 2, B3' is 2'-OMe or 2'-F, $q^5$ is 5, T3' is 2'-F, $q^6$ is 1, B4' is 2'-OMe, and $q^7$ is 1; with two phosphorothioate internucleotide linkage modifications within position 1-5 of the sense strand (counting from the 5'-end of the sense strand), and two phosphorothioate internucleotide linkage modifications at positions 1 and 2 and two phosphorothioate internucleotide linkage modifications within positions 18-23 of the antisense strand (counting from the 5'-end of the antisense strand). The dsRNA agent also comprises a 5'-P.

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, B1' is 2'-OMe or 2'-F, $q^1$ is 9, T1' is 2'-F, $q^2$ is 1, B2' is 2'-OMe or 2'-F, $q^3$ is 4, T2' is 2'-F, $q^4$ is 2, B3' is 2'-OMe or 2'-F, $q^5$ is 5, T3' is 2'-F, $q^6$ is 1, B4' is 2'-OMe, and $q^7$ is 1; with two phosphorothioate internucleotide linkage modifications within position 1-5 of the sense strand (counting from the 5'-end of the sense strand), and two phosphorothioate internucleotide linkage modifications at positions 1 and 2 and two phosphorothioate internucleotide linkage modifications within positions 18-23 of the antisense strand (counting from the 5'-end of the antisense strand). The dsRNA agent also comprises a 5'-PS.

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, B1' is 2'-OMe or 2'-F, $q^1$ is 9, T1' is 2'-F, $q^2$ is 1, B2' is 2'-OMe or 2'-F, $q^3$ is 4, T2' is 2'-F, $q^4$ is 2, B3' is 2'-OMe or 2'-F, $q^5$ is 5, T3' is 2'-F, $q^6$ is 1, B4' is 2'-OMe, and $q^7$ is 1; with two phosphorothioate internucleotide linkage modifications within position 1-5 of the sense strand (counting from the 5'-end of the sense strand), and two phosphorothioate internucleotide linkage modifications at positions 1 and 2 and two phosphorothioate internucleotide linkage modifications within positions 18-23 of the antisense strand (counting from the 5'-end of the antisense strand). The dsRNA agent also comprises a 5'-VP. The 5'-VP may be 5'-E-VP, 5'-Z-VP, or combination thereof.

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, B1' is 2'-OMe or 2'-F, $q^1$ is 9, T1' is 2'-F, $q^2$ is 1, B2' is 2'-OMe or 2'-F, $q^3$ is 4, T2' is 2'-F, $q^4$ is 2, B3' is 2'-OMe or 2'-F, $q^5$ is 5, T3' is 2'-F, $q^6$ is 1, B4' is 2'-OMe, and $q^7$ is 1; with two phosphorothioate internucleotide linkage modifications within position 1-5 of the sense strand (counting from the 5'-end of the sense strand), and two phosphorothioate internucleotide linkage modifications at positions 1 and 2 and two phosphorothioate internucleotide linkage modifications within positions 18-23 of the antisense strand (counting from the 5'-end of the antisense strand). The dsRNA agent also comprises a 5'-$PS_2$.

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, B1' is 2'-OMe or 2'-F, $q^1$ is 9, T1' is 2'-F, $q^2$ is 1, B2' is 2'-OMe or 2'-F, $q^3$ is 4, T2' is 2'-F, $q^4$ is 2, B3' is 2'-OMe or 2'-F, $q^5$ is 5, T3' is 2'-F, $q^6$ is 1, B4' is 2'-OMe, and $q^7$ is 1; with two phosphorothioate internucleotide linkage modifications within position 1-5 of the sense strand (counting from the 5'-end of the sense strand), and two phosphorothioate internucleotide linkage modifications at positions 1 and 2 and two phosphorothioate internucleotide linkage modifications within positions 18-23 of the antisense strand (counting from the 5'-end of the antisense strand). The dsRNA agent also comprises a 5'-deoxy-5'—C-malonyl.

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, B1' is 2'-OMe or 2'-F, $q^1$ is 9, T1' is 2'-F, $q^2$ is 1, B2' is 2'-OMe or 2'-F, $q^3$ is 4, $q^4$ is 0, B3' is 2'-OMe or 2'-F, $q^5$ is 7, T3' is 2'-F, $q^6$ is 1, B4' is 2'-OMe, and $q^7$ is 1. The dsRNA agent also comprises a 5'-P.

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, B1' is 2'-OMe or 2'-F, $q^1$ is 9, T1' is 2'-F, $q^2$ is 1, B2' is 2'-OMe or 2'-F, $q^3$ is 4, $q^4$ is 0, B3' is 2'-OMe or 2'-F, $q^5$ is 7, T3' is 2'-F, $q^6$ is 1, B4' is 2'-OMe, and $q^7$ is 1. The dsRNA agent also comprises a 5'-PS.

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, B1' is 2'-OMe or 2'-F, $q^1$ is 9, T1' is 2'-F, $q^2$ is 1, B2' is 2'-OMe or 2'-F, $q^3$ is 4, $q^4$ is 0, B3' is 2'-OMe or 2'-F, $q^5$ is 7, T3' is 2'-F, $q^6$ is 1, B4' is 2'-OMe, and $q^7$ is 1. The dsRNA agent also comprises a 5'-VP. The 5'-VP may be 5'-E-VP, 5'-Z-VP, or combination thereof.

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, B1' is 2'-OMe or 2'-F, $q^1$ is 9, T1' is 2'-F, $q^2$ is 1, B2' is 2'-OMe or 2'-F, $q^3$ is 4, $q^4$ is 0, B3' is 2'-OMe or 2'-F, $q^5$ is 7, T3' is 2'-F, $q^6$ is 1, B4' is 2'-OMe, and $q^7$ is 1. The dsRNA agent also comprises a 5'-PS$_2$.

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, B1' is 2'-OMe or 2'-F, $q^1$ is 9, T1' is 2'-F, $q^2$ is 1, B2' is 2'-OMe or 2'-F, $q^3$ is 4, $q^4$ is 0, B3' is 2'-OMe or 2'-F, $q^5$ is 7, T3' is 2'-F, $q^6$ is 1, B4' is 2'-OMe, and $q^7$ is 1. The dsRNA agent also comprises a 5'-deoxy-5'—C-malonyl.

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, B1' is 2'-OMe or 2'-F, $q^1$ is 9, T1' is 2'-F, $q^2$ is 1, B2' is 2'-OMe or 2'-F, $q^3$ is 4, $q^4$ is 0, B3' is 2'-OMe or 2'-F, $q^5$ is 7, T3' is 2'-F, $q^6$ is 1, B4' is 2'-OMe, and $q^7$ is 1; with two phosphorothioate internucleotide linkage modifications within position 1-5 of the sense strand (counting from the 5'-end), and two phosphorothioate internucleotide linkage modifications at positions 1 and 2 and two phosphorothioate internucleotide linkage modifications within positions 18-23 of the antisense strand (counting from the 5'-end). The dsRNA agent also comprises a 5'-P.

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, B1' is 2'-OMe or 2'-F, $q^1$ is 9, T1' is 2'-F, $q^2$ is 1, B2' is 2'-OMe or 2'-F, $q^3$ is 4, $q^4$ is 0, B3' is 2'-OMe or 2'-F, $q^5$ is 7, T3' is 2'-F, $q^6$ is 1, B4' is 2'-OMe, and $q^7$ is 1; with two phosphorothioate internucleotide linkage modifications within position 1-5 of the sense strand (counting from the 5'-end), and two phosphorothioate internucleotide linkage modifications at positions 1 and 2 and two phosphorothioate internucleotide linkage modifications within positions 18-23 of the antisense strand (counting from the 5'-end). The dsRNA agent also comprises a 5'-PS.

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, B1' is 2'-OMe or 2'-F, $q^1$ is 9, T1' is 2'-F, $q^2$ is 1, B2' is 2'-OMe or 2'-F, $q^3$ is 4, $q^4$ is 0, B3' is 2'-OMe or 2'-F, $q^5$ is 7, T3' is 2'-F, $q^6$ is 1, B4' is 2'-OMe, and $q^7$ is 1; with two phosphorothioate internucleotide linkage modifications within position 1-5 of the sense strand (counting from the 5'-end), and two phosphorothioate internucleotide linkage modifications at positions 1 and 2 and two phosphorothioate internucleotide linkage modifications within positions 18-23 of the antisense strand (counting from the 5'-end). The dsRNA agent also comprises a 5'-VP. The 5'-VP may be 5'-E-VP, 5'-Z-VP, or combination thereof.

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, B1' is 2'-OMe or 2'-F, $q^1$ is 9, T1' is 2'-F, $q^2$ is 1, B2' is 2'-OMe or 2'-F, $q^3$ is 4, $q^4$ is 0, B3' is 2'-OMe or 2'-F, $q^5$ is 7, T3' is 2'-F, $q^6$ is 1, B4' is 2'-OMe, and $q^7$ is 1; with two phosphorothioate internucleotide linkage modifications within position 1-5 of the sense strand (counting from the 5'-end), and two phosphorothioate internucleotide linkage modifications at positions 1 and 2 and two phosphorothioate internucleotide linkage modifications within positions 18-23 of the antisense strand (counting from the 5'-end). The dsRNA agent also comprises a 5'-PS$_2$.

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, B1' is 2'-OMe or 2'-F, $q^1$ is 9, T1' is 2'-F, $q^2$ is 1, B2' is 2'-OMe or 2'-F, $q^3$ is 4, $q^4$ is 0, B3' is 2'-OMe or 2'-F, $q^5$ is 7, T3' is 2'-F, $q^6$ is 1, B4' is 2'-OMe, and $q^7$ is 1; with two phosphorothioate internucleotide linkage modifications within position 1-5 of the sense strand (counting from the 5'-end), and two phosphorothioate internucleotide linkage modifications at positions 1 and 2 and two phosphorothioate internucleotide linkage modifications within positions 18-23 of the antisense strand (counting from the 5'-end). The dsRNA agent also comprises a 5'-deoxy-5'—C-malonyl.

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'OMe, $n^5$ is 3, B1' is 2'-OMe or 2'-F, $q^1$ is 9, T1' is 2'-F, $q^2$ is 1, B2' is 2'-OMe or 2'-F, $q^3$ is 4, T2' is 2'-F, $q^4$ is 2, B3' is 2'-OMe or 2'-F, $q^5$ is 5, T3' is 2'-F, $q^6$ is 1, B4' is 2'-F, and $q^7$ is 1. The dsRNA agent also comprises a 5'-P.

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'OMe, $n^5$ is 3, B1' is 2'-OMe or 2'-F, $q^1$ is 9, T1' is 2'-F, $q^2$ is 1, B2' is 2'-OMe or 2'-F, $q^3$ is 4, T2' is 2'-F, $q^4$ is 2, B3' is 2'-OMe or 2'-F, $q^5$ is 5, T3' is 2'-F, $q^6$ is 1, B4' is 2'-F, and $q^7$ is 1. The dsRNA agent also comprises a 5'-PS.

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'OMe, $n^5$ is 3, B1' is 2'-OMe or 2'-F, $q^1$ is 9, T1' is 2'-F, $q^2$ is 1, B2' is 2'-OMe or 2'-F, $q^3$ is 4, T2' is 2'-F, $q^4$ is 2, B3' is 2'-OMe or 2'-F, $q^5$ is 5, T3' is 2'-F, $q^6$ is 1, B4' is 2'-F, and $q^7$ is 1. The dsRNA agent also comprises a 5'-VP. The 5'-VP may be 5'-E-VP, 5'-Z-VP, or combination thereof.

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'OMe, $n^5$ is 3, B1' is 2'-OMe or 2'-F, $q^1$ is 9, T1' is 2'-F, $q^2$ is 1, B2' is 2'-OMe or 2'-F, $q^3$ is 4, T2' is 2'-F, $q^4$ is 2, B3' is 2'-OMe or 2'-F, $q^5$ is 5, T3' is 2'-F, $q^6$ is 1, B4' is 2'-F, and $q^7$ is 1. The dsRNA agent also comprises a 5'-PS$_2$.

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'OMe, $n^5$ is 3, B1' is 2'-OMe or 2'-F, $q^1$ is 9, T1' is 2'-F, $q^2$ is 1, B2' is 2'-OMe or 2'-F, $q^3$ is 4, T2' is 2'-F, $q^4$ is 2, B3' is 2'-OMe or 2'-F, $q^5$ is 5, T3' is 2'-F, $q^6$ is 1, B4' is 2'-F, and $q^7$ is 1. The dsRNA agent also comprises a 5'-deoxy-5'—C-malonyl.

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, B1' is 2'-OMe or 2'-F, $q^1$ is 9, T1' is 2'-F, $q^2$ is 1, B2' is 2'-OMe or 2'-F, $q^3$ is 4, T2' is 2'-F, $q^4$ is 2, B3' is 2'-OMe or 2'-F, $q^5$ is 5, T3' is 2'-F, $q^6$ is 1, B4' is 2'-F, and $q^7$ is 1; with two phosphorothioate internucleotide linkage modifications within position 1-5 of the sense strand (counting from the 5'-end of the sense strand), and two phosphorothioate internucleotide linkage modifications at positions 1 and 2 and two phosphorothioate internucleotide linkage modifications within positions 18-23 of the antisense strand (counting from the 5'-end of the antisense strand). The dsRNA agent also comprises a 5'-P.

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, B1' is 2'-OMe or 2'-F, $q^1$ is 9, T1' is 2'-F, $q^2$ is 1, B2' is 2'-OMe or 2'-F, $q^3$ is 4, T2' is 2'-F, $q^4$ is 2, B3' is 2'-OMe or 2'-F, $q^5$ is 5, T3' is 2'-F, $q^6$ is 1, B4' is 2'-F, and $q^7$ is 1; with two phosphorothioate internucleotide linkage modifications within position 1-5 of the sense strand (counting from the 5'-end of the sense strand), and two phosphorothioate internucleotide linkage modifications at positions 1 and 2 and two phosphorothioate internucleotide linkage modifications within positions 18-23 of the antisense strand (counting from the 5'-end of the antisense strand). The dsRNA agent also comprises a 5'-PS.

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, B1' is 2'-OMe or 2'-F, $q^1$ is 9, T1' is 2'-F, $q^2$ is 1, B2' is 2'-OMe or 2'-F, $q^3$ is 4, T2' is 2'-F, $q^4$ is 2, B3' is 2'-OMe or 2'-F, $q^5$ is 5, T3' is 2'-F, $q^6$ is 1, B4' is 2'-F, and $q^7$ is 1; with two phosphorothioate internucleotide linkage modifications within position 1-5 of the sense strand (counting from the 5'-end of the sense strand), and two phosphorothioate internucleotide linkage modifications at positions 1 and 2 and two phosphorothioate internucleotide linkage modifications within positions 18-23 of the antisense strand (counting from the 5'-end of the antisense strand). The dsRNA agent also comprises a 5'-VP. The 5'-VP may be 5'-E-VP, 5'-Z-VP, or combination thereof.

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, B1' is 2'-OMe or 2'-F, $q^1$ is 9, T1' is 2'-F, $q^2$ is 1, B2' is 2'-OMe or 2'-F, $q^3$ is 4, T2' is 2'-F, $q^4$ is 2, B3' is 2'-OMe or 2'-F, $q^5$ is 5, T3' is 2'-F, $q^6$ is 1, B4' is 2'-F, and $q^7$ is 1; with two phosphorothioate internucleotide linkage modifications within position 1-5 of the sense strand (counting from the 5'-end of the sense strand), and two phosphorothioate internucleotide linkage modifications at positions 1 and 2 and two phosphorothioate internucleotide linkage modifications within positions 18-23 of the antisense strand (counting from the 5'-end of the antisense strand). The dsRNA agent also comprises a 5'-$PS_2$.

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, B1' is 2'-OMe or 2'-F, $q^1$ is 9, T1' is 2'-F, $q^2$ is 1, B2' is 2'-OMe or 2'-F, $q^3$ is 4, T2' is 2'-F, $q^4$ is 2, B3' is 2'-OMe or 2'-F, $q^5$ is 5, T3' is 2'-F, $q^6$ is 1, B4' is 2'-F, and $q^7$ is 1; with two phosphorothioate internucleotide linkage modifications within position 1-5 of the sense strand (counting from the 5'-end of the sense strand), and two phosphorothioate internucleotide linkage modifications at positions 1 and 2 and two phosphorothioate internucleotide linkage modifications within positions 18-23 of the antisense strand (counting from the 5'-end of the antisense strand). The dsRNA agent also comprises a 5'-deoxy-5'—C-malonyl.

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, B1' is 2'-OMe or 2'-F, $q^1$ is 9, T1' is 2'-F, $q^2$ is 1, B2' is 2'-OMe or 2'-F, $q^3$ is 4, $q^4$ is 0, B3' is 2'-OMe or 2'-F, $q^5$ is 7, T3' is 2'-F, $q^6$ is 1, B4' is 2'-F, and $q^7$ is 1. The dsRNA agent also comprises a 5'-deoxy-5'—C-malonyl.

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, B1' is 2'-OMe or 2'-F, $q^1$ is 9, T1' is 2'-F, $q^2$ is 1, B2' is 2'-OMe or 2'-F, $q^3$ is 4, $q^4$ is 0, B3' is 2'-OMe or 2'-F, $q^5$ is 7, T3' is 2'-F, $q^6$ is 1, B4' is 2'-F, and $q^7$ is 1. The dsRNA agent also comprises a 5'-P.

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, B1' is 2'-OMe or 2'-F, $q^1$ is 9, T1' is 2'-F, $q^2$ is 1, B2' is 2'-OMe or 2'-F, $q^3$ is 4, $q^4$ is 0, B3' is 2'-OMe or 2'-F, $q^5$ is 7, T3' is 2'-F, $q^6$ is 1, B4' is 2'-F, and $q^7$ is 1. The dsRNA agent also comprises a 5'-PS.

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, B1' is 2'-OMe or 2'-F, $q^1$ is 9, T1' is 2'-F, $q^2$ is 1, B2' is 2'-OMe or 2'-F, $q^3$ is 4, $q^4$ is 0, B3' is 2'-OMe or 2'-F, $q^5$ is 7, T3' is 2'-F, $q^6$ is 1, B4' is 2'-F, and $q^7$ is 1. The dsRNA agent also comprises a 5'-VP. The 5'-VP may be 5'-E-VP, 5'-Z-VP, or combination thereof.

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, B1' is 2'-OMe or 2'-F, $q^1$ is 9, T1' is 2'-F, $q^2$ is 1, B2' is 2'-OMe or 2'-F, $q^3$ is 4, $q^4$ is 0, B3' is 2'-OMe or 2'-F, $q^5$ is 7, T3' is 2'-F, $q^6$ is 1, B4' is 2'-F, and $q^7$ is 1. The dsRNA agent also comprises a 5'-$PS_2$.

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, B1' is 2'-OMe or 2'-F, $q^1$ is 9, T1' is 2'-F, $q^2$ is 1, B2' is 2'-OMe or 2'-F, $q^3$ is 4, $q^4$ is 0, B3' is 2'-OMe or 2'-F, $q^5$ is 7, T3' is 2'-F, $q^6$ is 1, B4' is 2'-F, and $q^7$ is 1. The dsRNA agent also comprises a 5'-deoxy-5'—C-malonyl.

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, B1' is 2'-OMe or 2'-F, $q^1$ is 9, T1' is 2'-F, $q^2$ is 1, B2' is 2'-OMe or 2'-F, $q^3$ is 4, $q^4$ is 0, B3' is 2'-OMe or 2'-F, $q^5$ is 7, T3' is 2'-F, $q^6$ is 1, B4' is 2'-F, and $q^7$ is 1; with two phosphorothioate internucleotide linkage modifications within position 1-5 of the sense strand (counting from the 5'-end of the sense strand), and two phosphorothioate internucleotide linkage modifications at positions 1 and 2 and two phosphorothioate internucleotide linkage modifications within positions 18-23 of the antisense strand (counting from the 5'-end of the antisense strand). The dsRNA agent also comprises a 5'-P.

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, B1' is 2'-OMe or 2'-F, $q^1$ is 9, T1' is 2'-F, $q^2$ is 1, B2' is 2'-OMe or 2'-F, $q^3$ is 4, $q^4$ is 0, B3' is 2'-OMe or 2'-F, $q^5$ is 7, T3' is 2'-F, $q^6$ is 1, B4' is 2'-F, and $q^7$ is 1; with two phosphorothioate internucleotide linkage modifications within position 1-5 of the sense strand (counting from the 5'-end of the sense strand), and two phosphorothioate internucleotide linkage modifications at positions 1 and 2 and two phosphorothioate internucleotide linkage modifications within positions 18-23 of the antisense strand (counting from the 5'-end of the antisense strand). The dsRNA agent also comprises a 5'-PS.

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, B1' is 2'-OMe or 2'-F, $q^1$ is 9, T1' is 2'-F, $q^2$ is 1, B2' is 2'-OMe or 2'-F, $q^3$ is 4, $q^4$ is 0, B3' is 2'-OMe or 2'-F, $q^5$ is 7, T3' is 2'-F, $q^6$ is 1, B4' is 2'-F, and $q^7$ is 1; with two phosphorothioate internucleotide linkage modifications within position 1-5 of the sense strand (counting from the 5'-end of the sense strand), and two phosphorothioate internucleotide linkage modifications at positions 1 and 2 and two phosphorothioate internucleotide linkage modifications within positions 18-23 of the antisense strand (counting from the 5'-end of the antisense strand). The dsRNA agent also comprises a 5'-VP. The 5'-VP may be 5'-E-VP, 5'-Z-VP, or combination thereof.

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, B1' is 2'-OMe or 2'-F, $q^1$ is 9, T1' is 2'-F, $q^2$ is 1, B2' is 2'-OMe or 2'-F, $q^3$ is 4, $q^4$ is 0, B3' is 2'-OMe or 2'-F, $q^5$ is 7, T3' is 2'-F, $q^6$ is 1, B4' is 2'-F, and $q^7$ is 1; with two phosphorothioate internucleotide linkage modifications within position 1-5 of the sense strand (counting from the 5'-end of the sense strand), and two phosphorothioate internucleotide linkage modifications at positions 1 and 2 and two phosphorothioate internucleotide linkage modifications within positions 18-23 of the antisense strand (counting from the 5'-end of the antisense strand). The dsRNA agent also comprises a 5'-PS$_2$.

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, B1' is 2'-OMe or 2'-F, $q^1$ is 9, T1' is 2'-F, $q^2$ is 1, B2' is 2'-OMe or 2'-F, $q^3$ is 4, $q^4$ is 0, B3' is 2'-OMe or 2'-F, $q^5$ is 7, T3' is 2'-F, $q^6$ is 1, B4' is 2'-F, and $q^7$ is 1; with two phosphorothioate internucleotide linkage modifications within position 1-5 of the sense strand (counting from the 5'-end of the sense strand), and two phosphorothioate internucleotide linkage modifications at positions 1 and 2 and two phosphorothioate internucleotide linkage modifications within positions 18-23 of the antisense strand (counting from the 5'-end of the antisense strand). The dsRNA agent also comprises a 5'-deoxy-5'—C-malonyl.

In one embodiment, 100%, 95%, 90%, 85%, 80%, 75%, 70%, 65%, 60%, 55%, 50%, 45%, 40%, 35% or 30% of the dsRNA agent of the invention is modified. For example, when 50% of the dsRNA agent is modified, 50% of all nucleotides present in the dsRNA agent contain a modification as described herein.

In one embodiment, each of the sense and antisense strands of the dsRNA agent is independently modified with acyclic nucleotides, LNA, HNA, CeNA, 2'-methoxyethyl, 2'-O-methyl, 2'-O-allyl, 2'—C-allyl, 2'-deoxy, 2'-fluoro, 2'-O—N-methylacetamido (2'-O—NMA), a 2'-0-dimethyl-aminoethoxyethyl (2'-O-DMAEOE), 2'-O-aminopropyl (2'-O-AP), or 2'-ara-F.

In one embodiment, each of the sense and antisense strands of the dsRNA agent contains at least two different modifications.

In one embodiment, the dsRNA agent of Formula (I) further comprises 3' and/or 5' overhang(s) of 1-10 nucleotides in length. In one example, dsRNA agent of formula (I) comprises a 3' overhang at the 3'-end of the antisense strand and a blunt end at the 5'-end of the antisense strand. In another example, the dsRNA agent has a 5' overhang at the 5'-end of the sense strand.

In one embodiment, the dsRNA agent of the invention does not contain any 2'-F modification.

In one embodiment, the sense strand and/or antisense strand of the dsRNA agent comprises one or more blocks of phosphorothioate or methylphosphonate internucleotide linkages. In one example, the sense strand comprises one block of two phosphorothioate or methylphosphonate internucleotide linkages. In one example, the antisense strand comprises two blocks of two phosphorothioate or methylphosphonate internucleotide linkages. For example, the two blocks of phosphorothioate or methylphosphonate internucleotide linkages are separated by 16-18 phosphate internucleotide linkages.

In one embodiment, each of the sense and antisense strands of the dsRNA agent has 15-30 nucleotides. In one example, the sense strand has 19-22 nucleotides, and the antisense strand has 19-25 nucleotides. In another example, the sense strand has 21 nucleotides, and the antisense strand has 23 nucleotides.

In one embodiment, the nucleotide at position 1 of the 5'-end of the antisense strand in the duplex is selected from the group consisting of A, dA, dU, U, and dT. In one embodiment, at least one of the first, second, and third base pair from the 5'-end of the antisense strand is an AU base pair.

In one embodiment, the antisense strand of the dsRNA agent of the invention is 100% complementary to a target RNA to hybridize thereto and inhibits its expression through RNA interference. In another embodiment, the antisense strand of the dsRNA agent of the invention is at least 95%, at least 90%, at least 85%, at least 80%, at least 75%, at least 70%, at least 65%, at least 60%, at least 55%, or at least 50% complementary to a target RNA.

In one aspect, the invention relates to a dsRNA agent as defined herein capable of inhibiting the expression of a target gene. The dsRNA agent comprises a sense strand and an antisense strand, each strand having 14 to 40 nucleotides. The sense strand contains at least one thermally destabilizing nucleotide, wherein at least one of said thermally destabilizing nucleotide occurs at or near the site that is opposite to the seed region of the antisense strand (i.e. at position 2-8 of the 5'-end of the antisense strand). Each of the embodiments and aspects described in this specification relating to the dsRNA represented by formula (I) can also apply to the dsRNA containing the thermally destabilizing nucleotide.

The thermally destabilizing nucleotide can occur, for example, between positions 14-17 of the 5'-end of the sense strand when the sense strand is 21 nucleotides in length. The antisense strand contains at least two modified nucleic acids that are smaller than a sterically demanding 2'-OMe modification. Preferably, the two modified nucleic acids that are smaller than a sterically demanding 2'-OMe are separated by 11 nucleotides in length. For example, the two modified nucleic acids are at positions 2 and 14 of the 5'end of the antisense strand.

In one embodiment, the dsRNA agent further comprises at least one ASGPR ligand. For example, the ASGPR ligand is one or more GalNAc derivatives attached through a bivalent or trivalent branched linker, such as:

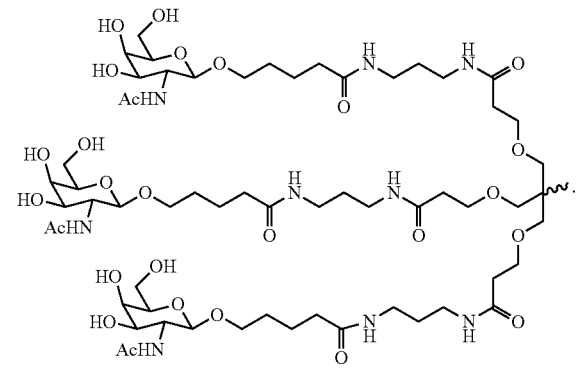 [SMILES: CC(=O)NC1C(OCCCCC(=O)NCCCNC(=O)CCOCC(C)(COCCC(=O)NCCCNC(=O)CCCCOC2OC(CO)C(O)C(O)C2NC(C)=O)COCCC(=O)NCCCNC(=O)CCCCOC2OC(CO)C(O)C(O)C2NC(C)=O)OC(CO)C(O)C1O]

In one example, the ASGPR ligand is attached to the 3' end of the sense strand.

For example, the dsRNA agent as defined herein can comprise i) a phosphorus-containing group at the 5'-end of the sense strand or antisense strand; ii) with two phosphorothioate internucleotide linkage modifications within position 1-5 of the sense strand (counting from the 5'-end of the sense strand), and two phosphorothioate internucleotide linkage modifications at positions 1 and 2 and two phosphorothioate internucleotide linkage modifications within positions 18-23 of the antisense strand (counting from the 5'-end of the antisense strand); and iii) a ligand, such as a ASGPR ligand (e.g., one or more GalNAc derivatives) at 5'-end or 3'-end of the sense strand or antisense strand. For instance, the ligand may be at the 3'-end of the sense strand.

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, B1' is 2'-OMe or 2'-F, $q^1$ is 9, T1' is 2'-F, $q^2$ is 1, B2' is 2'-OMe or 2'-F, $q^3$ is 4, T2' is 2'-F, $q^4$ is 2, B3' is 2'-OMe or 2'-F, $q^5$ is 5, T3' is 2'-F, $q^6$ is 1, B4' is 2'-OMe, and $q^7$ is 1; with two phosphorothioate internucleotide linkage modifications within position 1-5 of the sense strand (counting from the 5'-end of the sense strand), and two phosphorothioate internucleotide linkage modifications at positions 1 and 2 and two phosphorothioate internucleotide linkage modifications within positions 18-23 of the antisense strand (counting from the 5'-end of the antisense strand). The dsRNA agent also comprises a 5'-P and a targeting ligand. In one embodiment, the 5'-P is at the 5'-end of the antisense strand, and the targeting ligand is at the 3'-end of the sense strand.

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, B1' is 2'-OMe or 2'-F, $q^1$ is 9, T1' is 2'-F, $q^2$ is 1, B2' is 2'-OMe or 2'-F, $q^3$ is 4, T2' is 2'-F, $q^4$ is 2, B3' is 2'-OMe or 2'-F, $q^5$ is 5, T3' is 2'-F, $q^6$ is 1, B4' is 2'-OMe, and $q^7$ is 1; with two phosphorothioate internucleotide linkage modifications within position 1-5 of the sense strand (counting from the 5'-end of the sense strand), and two phosphorothioate internucleotide linkage modifications at positions 1 and 2 and two phosphorothioate internucleotide linkage modifications within positions 18-23 of the antisense strand (counting from the 5'-end of the antisense strand). The dsRNA agent also comprises a 5'-PS and a targeting ligand. In one embodiment, the 5'-PS is at the 5'-end of the antisense strand, and the targeting ligand is at the 3'-end of the sense strand.

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, B1' is 2'-OMe or 2'-F, $q^1$ is 9, T1' is 2'-F, $q^2$ is 1, B2' is 2'-OMe or 2'-F, $q^3$ is 4, T2' is 2'-F, $q^4$ is 2, B3' is 2'-OMe or 2'-F, $q^5$ is 5, T3' is 2'-F, $q^6$ is 1, B4' is 2'-OMe, and $q^7$ is 1; with two phosphorothioate internucleotide linkage modifications within position 1-5 of the sense strand (counting from the 5'-end of the sense strand), and two phosphorothioate internucleotide linkage modifications at positions 1 and 2 and two phosphorothioate internucleotide linkage modifications within positions 18-23 of the antisense strand (counting from the 5'-end of the antisense strand). The dsRNA agent also comprises a 5'-VP (e.g., a 5'-E-VP, 5'-Z-VP, or combination thereof), and a targeting ligand. In one embodiment, the 5'-VP is at the 5'-end of the antisense strand, and the targeting ligand is at the 3'-end of the sense strand.

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, B1' is 2'-OMe or 2'-F, $q^1$ is 9, T1' is 2'-F, $q^2$ is 1, B2' is 2'-OMe or 2'-F, $q^3$ is 4, T2' is 2'-F, $q^4$ is 2, B3' is 2'-OMe or 2'-F, $q^5$ is 5, T3' is 2'-F, $q^6$ is 1, B4' is 2'-OMe, and $q^7$ is 1; with two phosphorothioate internucleotide linkage modifications within position 1-5 of the sense strand (counting from the 5'-end of the sense strand), and two phosphorothioate internucleotide linkage modifications at positions 1 and 2 and two phosphorothioate internucleotide linkage modifications within positions 18-23 of the antisense strand (counting from the 5'-end of the antisense strand). The dsRNA agent also comprises a 5'-PS$_2$ and a targeting ligand. In one embodiment, the 5'-PS$_2$ is at the 5'-end of the antisense strand, and the targeting ligand is at the 3'-end of the sense strand.

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, B1' is 2'-OMe or 2'-F, $q^1$ is 9, T1' is 2'-F, $q^2$ is 1, B2' is 2'-OMe or 2'-F, $q^3$ is 4, T2' is 2'-F, $q^4$ is 2, B3' is 2'-OMe or 2'-F, $q^5$ is 5, T3' is 2'-F, $q^6$ is 1, B4' is 2'-OMe, and $q^7$ is 1; with two phosphorothioate internucleotide linkage modifications within position 1-5 of the sense strand (counting from the 5'-end of the sense strand), and two phosphorothioate internucleotide linkage modifications at positions 1 and 2 and two phosphorothioate internucleotide linkage modifications within positions 18-23 of the antisense strand (counting from the 5'-end of the antisense strand). The dsRNA agent also comprises a 5'-deoxy-5'—C-malonyl and a targeting ligand. In one embodiment, the 5'-deoxy-5'—C-malonyl is at the 5'-end of the antisense strand, and the targeting ligand is at the 3'-end of the sense strand.

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, B1' is 2'-OMe or 2'-F, $q^1$ is 9, T1' is 2'-F, $q^2$ is 1, B2' is 2'-OMe or 2'-F, $q^3$ is 4, $q^4$ is 0, B3' is 2'-OMe or 2'-F, $q^5$ is 7, T3' is 2'-F, $q^6$ is 1, B4' is 2'-OMe, and $q^7$ is 1; with two phosphorothioate internucleotide linkage modifications within position 1-5 of the sense strand (counting from the 5'-end), and two phosphorothioate internucleotide linkage modifications at positions 1 and 2 and two phosphorothioate internucleotide linkage modifications within positions 18-23 of the antisense strand (counting from the 5'-end). The dsRNA agent also comprises a 5'-P and a targeting ligand. In one embodiment, the 5'-P is at the 5'-end of the antisense strand, and the targeting ligand is at the 3'-end of the sense strand.

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, B1' is 2'-OMe or 2'-F, $q^1$ is 9, T1' is 2'-F, $q^2$ is 1, B2' is 2'-OMe or 2'-F, $q^3$ is 4, $q^4$ is 0, B3' is 2'-OMe or 2'-F, $q^5$ is 7, T3' is 2'-F, $q^6$ is 1, B4' is 2'-OMe, and $q^7$ is 1; with two phosphorothioate internucleotide linkage modifications within position 1-5 of the sense strand (counting from the 5'-end), and two phosphorothioate internucleotide linkage modifications at positions 1 and 2 and two phosphorothioate internucleotide linkage modifications within positions 18-23 of the antisense strand (counting from the 5'-end). The dsRNA agent also comprises a 5'-PS and a targeting ligand. In one embodiment, the 5'-PS is at the 5'-end of the antisense strand, and the targeting ligand is at the 3'-end of the sense strand.

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, B1' is 2'-OMe or 2'-F, $q^1$ is 9, T1' is 2'-F, $q^2$ is 1, B2' is 2'-OMe or 2'-F, $q^3$ is 4, $q^4$ is 0, B3' is 2'-OMe or 2'-F, $q^5$ is 7, T3' is 2'-F, $q^6$ is 1, B4' is 2'-OMe, and $q^7$ is 1; with two phosphorothioate internucleotide linkage modifications within position 1-5 of the sense strand (counting from the 5'-end), and two phosphorothioate internucleotide linkage modifications at positions 1 and 2 and two phosphorothioate internucleotide linkage modifications within positions 18-23 of the antisense strand (counting from the 5'-end). The dsRNA agent also comprises a 5'-VP (e.g., a 5'-E-VP, 5'-Z-VP, or combination thereof) and a targeting ligand. In one embodiment, the 5'-VP is at the 5'-end of the antisense strand, and the targeting ligand is at the 3'-end of the sense strand.

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, B1' is 2'-OMe or 2'-F, $q^1$ is 9, T1' is 2'-F, $q^2$ is 1, B2' is 2'-OMe or 2'-F, $q^3$ is 4, $q^4$ is 0, B3' is 2'-OMe or 2'-F, $q^5$ is 7, T3' is 2'-F, $q^6$ is 1, B4' is 2'-OMe, and $q^7$ is 1; with two phosphorothioate internucleotide linkage modifications within position 1-5 of the sense strand (counting from the 5'-end), and two phosphorothioate internucleotide linkage modifications at positions 1 and 2 and two phosphorothioate internucleotide linkage modifications within positions 18-23 of the antisense strand (counting from the 5'-end). The dsRNA agent also comprises a 5'-PS$_2$ and a targeting ligand. In one embodiment, the 5'-PS$_2$ is at the 5'-end of the antisense strand, and the targeting ligand is at the 3'-end of the sense strand.

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, B1' is 2'-OMe or 2'-F, $q^1$ is 9, T1' is 2'-F, $q^2$ is 1, B2' is 2'-OMe or 2'-F, $q^3$ is 4, $q^4$ is 0, B3' is 2'-OMe or 2'-F, $q^5$ is 7, T3' is 2'-F, $q^6$ is 1, B4' is 2'-OMe, and $q^7$ is 1; with two phosphorothioate internucleotide linkage modifications within position 1-5 of the sense strand (counting from the 5'-end), and two phosphorothioate internucleotide linkage modifications at positions 1 and 2 and two phosphorothioate internucleotide linkage modifications within positions 18-23 of the antisense strand (counting from the 5'-end). The dsRNA agent also comprises a 5'-deoxy-5'—C-malonyl and a targeting ligand. In one embodiment, the 5'-deoxy-5'—C-malonyl is at the 5'-end of the antisense strand, and the targeting ligand is at the 3'-end of the sense strand.

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, B1' is 2'-OMe or 2'-F, $q^1$ is 9, T1' is 2'-F, $q^2$ is 1, B2' is 2'-OMe or 2'-F, $q^3$ is 4, T2' is 2'-F, $q^4$ is 2, B3' is 2'-OMe or 2'-F, $q^5$ is 5, T3' is 2'-F, $q^6$ is 1, B4' is 2'-F, and $q^7$ is 1; with two phosphorothioate internucleotide linkage modifications within position 1-5 of the sense strand (counting from the 5'-end of the sense strand), and two phosphorothioate internucleotide linkage modifications at positions 1 and 2 and two phosphorothioate internucleotide linkage modifications within positions 18-23 of the antisense strand (counting from the 5'-end of the antisense strand). The dsRNA agent also comprises a 5'-P and a targeting ligand. In one embodiment, the 5'-P is at the 5'-end of the antisense strand, and the targeting ligand is at the 3'-end of the sense strand.

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, B1' is 2'-OMe or 2'-F, $q^1$ is 9, T1' is 2'-F, $q^2$ is 1, B2' is 2'-OMe or 2'-F, $q^3$ is 4, T2' is 2'-F, $q^4$ is 2, B3' is 2'-OMe or 2'-F, $q^5$ is 5, T3' is 2'-F, $q^6$ is 1, B4' is 2'-F, and $q^7$ is 1; with two phosphorothioate internucleotide linkage modifications within position 1-5 of the sense strand (counting from the 5'-end of the sense strand), and two phosphorothioate internucleotide linkage modifications at positions 1 and 2 and two phosphorothioate internucleotide linkage modifications within positions 18-23 of the antisense strand (counting from the 5'-end of the antisense strand). The dsRNA agent also comprises a 5'-PS and a targeting ligand. In one embodiment, the 5'-PS is at the 5'-end of the antisense strand, and the targeting ligand is at the 3'-end of the sense strand.

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, B1' is 2'-OMe or 2'-F, $q^1$ is 9, T1' is 2'-F, $q^2$ is 1, B2' is 2'-OMe or 2'-F, $q^3$ is 4, T2' is 2'-F, $q^4$ is 2, B3' is 2'-OMe or 2'-F, $q^5$ is 5, T3' is 2'-F, $q^6$ is 1, B4' is 2'-F, and $q^7$ is 1; with two phosphorothioate internucleotide linkage modifications within position 1-5 of the sense strand (counting from the 5'-end of the sense strand), and two phosphorothioate internucleotide linkage modifications at positions 1 and 2 and two phosphorothioate internucleotide linkage modifications within positions 18-23 of the antisense strand (counting from the 5'-end of the antisense strand). The dsRNA agent also comprises a 5'-VP (e.g., a 5'-E-VP, 5'-Z-VP, or combination thereof) and a targeting ligand. In one embodiment, the 5'-VP is at the 5'-end of the antisense strand, and the targeting ligand is at the 3'-end of the sense strand.

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, B1' is 2'-OMe or 2'-F, $q^1$ is 9, T1' is 2'-F, $q^2$ is 1, B2' is 2'-OMe or 2'-F, $q^3$ is 4, T2' is 2'-F, $q^4$ is 2, B3' is 2'-OMe or 2'-F, $q^5$ is 5, T3' is 2'-F, $q^6$ is 1, B4' is 2'-F, and $q^7$ is 1; with two phosphorothioate internucleotide linkage modifications within position 1-5 of the sense strand (counting from the 5'-end of the sense strand), and two phosphorothioate internucleotide linkage modifications at positions 1 and 2 and two phosphorothioate internucleotide linkage modifications within positions 18-23 of the antisense strand (counting from the 5'-end of the antisense strand). The dsRNA agent also comprises a 5'-PS$_2$ and a targeting ligand. In one embodiment, the 5'-PS$_2$ is at the 5'-end of the antisense strand, and the targeting ligand is at the 3'-end of the sense strand.

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, B1' is 2'-OMe or 2'-F, $q^1$ is 9, T1' is 2'-F, $q^2$ is 1, B2' is 2'-OMe or 2'-F, $q^3$ is 4, T2' is 2'-F, $q^4$ is 2, B3' is 2'-OMe or 2'-F, $q^5$ is 5, T3' is 2'-F, $q^6$ is 1, B4' is 2'-F, and $q^7$ is 1; with two phosphorothioate internucleotide linkage modifications within position 1-5 of the sense strand (counting from the 5'-end of the sense strand), and two phosphorothioate internucleotide linkage modifications at positions 1 and 2 and two phosphorothioate internucleotide linkage modifications within positions 18-23 of the antisense strand (counting from the 5'-end of the antisense strand). The dsRNA agent also comprises a 5'-deoxy-5'—C-malonyl and a targeting ligand. In one embodiment, the 5'-deoxy-5'—C-malonyl is at the 5'-end of the antisense strand, and the targeting ligand is at the 3'-end of the sense strand.

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, B1' is 2'-OMe or 2'-F, $q^1$ is 9, T1' is 2'-F, $q^2$ is 1, B2' is 2'-OMe or 2'-F, $q^3$ is 4, $q^4$ is 0, B3' is 2'-OMe or 2'-F, $q^5$ is 7, T3' is 2'-F, $q^6$ is 1, B4' is 2'-F, and $q^7$ is 1; with two phosphorothioate internucleotide linkage modifications within position 1-5 of the sense strand (counting from the 5'-end of the sense strand), and two phosphorothioate internucleotide linkage modifications at positions 1 and 2 and two phosphorothioate internucleotide linkage modifications within positions 18-23 of the antisense strand (counting from the 5'-end of the antisense strand). The dsRNA agent also comprises a 5'-P and a targeting ligand. In one embodiment, the 5'-P is at the 5'-end of the antisense strand, and the targeting ligand is at the 3'-end of the sense strand.

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, B1' is 2'-OMe or 2'-F, $q^1$ is 9, T1' is 2'-F, $q^2$ is 1, B2' is 2'-OMe or 2'-F, $q^3$ is 4, $q^4$ is 0, B3' is 2'-OMe or 2'-F, $q^5$ is 7, T3' is 2'-F, $q^6$ is 1, B4' is 2'-F, and $q^7$ is 1; with two phosphorothioate internucleotide linkage modifications within position 1-5 of the sense strand (counting from the 5'-end of the sense strand), and two phosphorothioate internucleotide linkage modifications at positions 1 and 2 and two phosphorothioate internucleotide linkage modifications within positions 18-23 of the antisense strand (counting from the 5'-end of the antisense strand). The dsRNA agent also comprises a 5'-PS and a targeting ligand. In one embodiment, the 5'-PS is at the 5'-end of the antisense strand, and the targeting ligand is at the 3'-end of the sense strand.

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, B1' is 2'-OMe or 2'-F, $q^1$ is 9, T1' is 2'-F, $q^2$ is 1, B2' is 2'-OMe or 2'-F, $q^3$ is 4, $q^4$ is 0, B3' is 2'-OMe or 2'-F, $q^5$ is 7, T3' is 2'-F, $q^6$ is 1, B4' is 2'-F, and $q^7$ is 1; with two phosphorothioate internucleotide linkage modifications within position 1-5 of the sense strand (counting from the 5'-end of the sense strand), and two phosphorothioate internucleotide linkage modifications at positions 1 and 2 and two phosphorothioate internucleotide linkage modifications within positions 18-23 of the antisense strand (counting from the 5'-end of the antisense strand). The dsRNA agent also comprises a 5'-VP (e.g., a 5'-E-VP, 5'-Z-VP, or combination thereof) and a targeting ligand. In one embodiment, the 5'-VP is at the 5'-end of the antisense strand, and the targeting ligand is at the 3'-end of the sense strand.

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, B1' is 2'-OMe or 2'-F, $q^1$ is 9, T1' is 2'-F, $q^2$ is 1, B2' is 2'-OMe or 2'-F, $q^3$ is 4, $q^4$ is 0, B3' is 2'-OMe or 2'-F, $q^5$ is 7, T3' is 2'-F, $q^6$ is 1, B4' is 2'-F, and $q^7$ is 1; with two phosphorothioate internucleotide linkage modifications within position 1-5 of the sense strand (counting from the 5'-end of the sense strand), and two phosphorothioate internucleotide linkage modifications at positions 1 and 2 and two phosphorothioate internucleotide linkage modifications within positions 18-23 of the antisense strand (counting from the 5'-end of the antisense strand). The dsRNA agent also comprises a 5'-$PS_2$ and a targeting ligand. In one embodiment, the 5'-$PS_2$ is at the 5'-end of the antisense strand, and the targeting ligand is at the 3'-end of the sense strand.

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, B1' is 2'-OMe or 2'-F, $q^1$ is 9, T1' is 2'-F, $q^2$ is 1, B2' is 2'-OMe or 2'-F, $q^3$ is 4, $q^4$ is 0, B3' is 2'-OMe or 2'-F, $q^5$ is 7, T3' is 2'-F, $q^6$ is 1, B4' is 2'-F, and $q^7$ is 1; with two phosphorothioate internucleotide linkage modifications within position 1-5 of the sense strand (counting from the 5'-end of the sense strand), and two phosphorothioate internucleotide linkage modifications at positions 1 and 2 and two phosphorothioate internucleotide linkage modifications within positions 18-23 of the antisense strand (counting from the 5'-end of the antisense strand). The dsRNA agent also comprises a 5'-deoxy-5'—C-malonyl and a targeting ligand. In one embodiment, the 5'-deoxy-5'—C-malonyl is at the 5'-end of the antisense strand, and the targeting ligand is at the 3'-end of the sense strand.

In a particular embodiment, the dsRNA agents of the present invention comprise:
(a) a sense strand having:
 (i) a length of 21 nucleotides;
 (ii) an ASGPR ligand attached to the 3'-end, wherein said ASGPR ligand comprises three GalNAc derivatives attached through a trivalent branched linker; and
 (iii) 2'-F modifications at positions 1, 3, 5, 7, 9 to 11, 13, 17, 19, and 21, and 2'-OMe modifications at positions 2, 4, 6, 8, 12, 14 to 16, 18, and 20 (counting from the 5' end);
 and
(b) an antisense strand having:
 (i) a length of 23 nucleotides;
 (ii) 2'-OMe modifications at positions 1, 3, 5, 9, 11 to 13, 15, 17, 19, 21, and 23, and 2'F modifications at positions 2, 4, 6 to 8, 10, 14, 16, 18, 20, and 22 (counting from the 5' end); and
 (iii) phosphorothioate internucleotide linkages between nucleotide positions 21 and 22, and between nucleotide positions 22 and 23 (counting from the 5' end);
wherein the dsRNA agents have a two nucleotide overhang at the 3'-end of the antisense strand, and a blunt end at the 5'-end of the antisense strand.

In another particular embodiment, the dsRNA agents of the present invention comprise:
(a) a sense strand having:
 (i) a length of 21 nucleotides;
 (ii) an ASGPR ligand attached to the 3'-end, wherein said ASGPR ligand comprises three GalNAc derivatives attached through a trivalent branched linker;
 (iii) 2'-F modifications at positions 1, 3, 5, 7, 9 to 11, 13, 15, 17, 19, and 21, and 2'-OMe modifications at positions 2, 4, 6, 8, 12, 14, 16, 18, and 20 (counting from the 5' end); and
 (iv) phosphorothioate internucleotide linkages between nucleotide positions 1 and 2, and between nucleotide positions 2 and 3 (counting from the 5' end);
 and
(b) an antisense strand having:
 (i) a length of 23 nucleotides;
 (ii) 2'-OMe modifications at positions 1, 3, 5, 7, 9, 11 to 13, 15, 17, 19, and 21 to 23, and 2'F modifications at positions 2, 4, 6, 8, 10, 14, 16, 18, and 20 (counting from the 5' end); and
 (iii) phosphorothioate internucleotide linkages between nucleotide positions 1 and 2, between nucleotide positions 2 and 3, between nucleotide positions 21 and 22, and between nucleotide positions 22 and 23 (counting from the 5' end);
wherein the dsRNA agents have a two nucleotide overhang at the 3'-end of the antisense strand, and a blunt end at the 5'-end of the antisense strand.

In another particular embodiment, the dsRNA agents of the present invention comprise:
(a) a sense strand having:
 (i) a length of 21 nucleotides;
 (ii) an ASGPR ligand attached to the 3'-end, wherein said ASGPR ligand comprises three GalNAc derivatives attached through a trivalent branched linker;
 (iii) 2'-OMe modifications at positions 1 to 6, 8, 10, and 12 to 21, 2'-F modifications at positions 7, and 9, and a desoxy-nucleotide (e.g. dT) at position 11 (counting from the 5' end); and (iv) phosphorothioate internucleotide linkages between nucleotide positions 1 and 2, and between nucleotide positions 2 and 3 (counting from the 5' end); and (b) an antisense strand having:
(i) a length of 23 nucleotides;
(ii) 2'-OMe modifications at positions 1, 3, 7, 9, 11, 13, 15, 17, and 19 to 23, and 2'-F modifications at positions 2, 4 to 6, 8, 10, 12, 14, 16, and 18 (counting from the 5' end); and
(iii) phosphorothioate internucleotide linkages between nucleotide positions 1 and 2, between nucleotide positions 2 and 3, between nucleotide positions 21 and 22, and between nucleotide positions 22 and 23 (counting from the 5' end);

wherein the dsRNA agents have a two nucleotide overhang at the 3'-end of the antisense strand, and a blunt end at the 5'-end of the antisense strand.

In another particular embodiment, the dsRNA agents of the present invention comprise:
(a) a sense strand having:
(i) a length of 21 nucleotides;
(ii) an ASGPR ligand attached to the 3'-end, wherein said ASGPR ligand comprises three GalNAc derivatives attached through a trivalent branched linker;
(iii) 2'-OMe modifications at positions 1 to 6, 8, 10, 12, 14, and 16 to 21, and 2'-F modifications at positions 7, 9, 11, 13, and 15; and
(iv) phosphorothioate internucleotide linkages between nucleotide positions 1 and 2, and between nucleotide positions 2 and 3 (counting from the 5' end); and (b) an antisense strand having:
(i) a length of 23 nucleotides;
(ii) 2'-OMe modifications at positions 1, 5, 7, 9, 11, 13, 15, 17, 19, and 21 to 23, and 2'-F modifications at positions 2 to 4, 6, 8, 10, 12, 14, 16, 18, and 20 (counting from the 5' end); and
(iii) phosphorothioate internucleotide linkages between nucleotide positions 1 and 2, between nucleotide positions 2 and 3, between nucleotide positions 21 and 22, and between nucleotide positions 22 and 23 (counting from the 5' end);

wherein the dsRNA agents have a two nucleotide overhang at the 3'-end of the antisense strand, and a blunt end at the 5'-end of the antisense strand.

In another particular embodiment, the dsRNA agents of the present invention comprise:
(a) a sense strand having:
(i) a length of 21 nucleotides;
(ii) an ASGPR ligand attached to the 3'-end, wherein said ASGPR ligand comprises three GalNAc derivatives attached through a trivalent branched linker;
(iii) 2'-OMe modifications at positions 1 to 9, and 12 to 21, and 2'-F modifications at positions 10, and 11; and
(iv) phosphorothioate internucleotide linkages between nucleotide positions 1 and 2, and between nucleotide positions 2 and 3 (counting from the 5' end); and (b) an antisense strand having:
(i) a length of 23 nucleotides;
(ii) 2'-OMe modifications at positions 1, 3, 5, 7, 9, 11 to 13, 15, 17, 19, and 21 to 23, and 2'-F modifications at positions 2, 4, 6, 8, 10, 14, 16, 18, and 20 (counting from the 5' end); and
(iii) phosphorothioate internucleotide linkages between nucleotide positions 1 and 2, between nucleotide positions 2 and 3, between nucleotide positions 21 and 22, and between nucleotide positions 22 and 23 (counting from the 5' end);

wherein the dsRNA agents have a two nucleotide overhang at the 3'-end of the antisense strand, and a blunt end at the 5'-end of the antisense strand.

In another particular embodiment, the dsRNA agents of the present invention comprise:
(a) a sense strand having:
(i) a length of 21 nucleotides;
(ii) an ASGPR ligand attached to the 3'-end, wherein said ASGPR ligand comprises three GalNAc derivatives attached through a trivalent branched linker;
(iii) 2'-F modifications at positions 1, 3, 5, 7, 9 to 11, and 13, and 2'-OMe modifications at positions 2, 4, 6, 8, 12, and 14 to 21; and
(iv) phosphorothioate internucleotide linkages between nucleotide positions 1 and 2, and between nucleotide positions 2 and 3 (counting from the 5' end); and (b) an antisense strand having:
(i) a length of 23 nucleotides;
(ii) 2'-OMe modifications at positions 1, 3, 5 to 7, 9, 11 to 13, 15, 17 to 19, and 21 to 23, and 2'-F modifications at positions 2, 4, 8, 10, 14, 16, and 20 (counting from the 5' end); and
(iii) phosphorothioate internucleotide linkages between nucleotide positions 1 and 2, between nucleotide positions 2 and 3, between nucleotide positions 21 and 22, and between nucleotide positions 22 and 23 (counting from the 5' end);

wherein the dsRNA agents have a two nucleotide overhang at the 3'-end of the antisense strand, and a blunt end at the 5'-end of the antisense strand.

In another particular embodiment, the dsRNA agents of the present invention comprise:
(a) a sense strand having:
(i) a length of 21 nucleotides;
(ii) an ASGPR ligand attached to the 3'-end, wherein said ASGPR ligand comprises three GalNAc derivatives attached through a trivalent branched linker;
(iii) 2'-OMe modifications at positions 1, 2, 4, 6, 8, 12, 14, 15, 17, and 19 to 21, and 2'-F modifications at positions 3, 5, 7, 9 to 11, 13, 16, and 18; and
(iv) phosphorothioate internucleotide linkages between nucleotide positions 1 and 2, and between nucleotide positions 2 and 3 (counting from the 5' end); and (b) an antisense strand having:
(i) a length of 25 nucleotides;
(ii) 2'-OMe modifications at positions 1, 4, 6, 7, 9, 11 to 13, 15, 17, and 19 to 23, 2'-F modifications at positions 2, 3, 5, 8, 10, 14, 16, and 18, and desoxy-nucleotides (e.g. dT) at positions 24 and 25 (counting from the 5' end); and
(iii) phosphorothioate internucleotide linkages between nucleotide positions 1 and 2, between nucleotide positions 2 and 3, between nucleotide positions 21 and 22, and between nucleotide positions 22 and 23 (counting from the 5' end);

wherein the dsRNA agents have a four nucleotide overhang at the 3'-end of the antisense strand, and a blunt end at the 5'-end of the antisense strand.

In another particular embodiment, the dsRNA agents of the present invention comprise:

(a) a sense strand having:
  (i) a length of 21 nucleotides;
  (ii) an ASGPR ligand attached to the 3'-end, wherein said ASGPR ligand comprises three GalNAc derivatives attached through a trivalent branched linker;
  (iii) 2'-OMe modifications at positions 1 to 6, 8, and 12 to 21, and 2'-F modifications at positions 7, and 9 to 11; and
  (iv) phosphorothioate internucleotide linkages between nucleotide positions 1 and 2, and between nucleotide positions 2 and 3 (counting from the 5' end); and (b) an antisense strand having:
  (i) a length of 23 nucleotides;
  (ii) 2'-OMe modifications at positions 1, 3 to 5, 7, 8, 10 to 13, 15, and 17 to 23, and 2'-F modifications at positions 2, 6, 9, 14, and 16 (counting from the 5' end); and
  (iii) phosphorothioate internucleotide linkages between nucleotide positions 1 and 2, between nucleotide positions 2 and 3, between nucleotide positions 21 and 22, and between nucleotide positions 22 and 23 (counting from the 5' end);

wherein the dsRNA agents have a two nucleotide overhang at the 3'-end of the antisense strand, and a blunt end at the 5'-end of the antisense strand.

In another particular embodiment, the dsRNA agents of the present invention comprise:

(a) a sense strand having:
  (i) a length of 21 nucleotides;
  (ii) an ASGPR ligand attached to the 3'-end, wherein said ASGPR ligand comprises three GalNAc derivatives attached through a trivalent branched linker;
  (iii) 2'-OMe modifications at positions 1 to 6, 8, and 12 to 21, and 2'-F modifications at positions 7, and 9 to 11; and
  (iv) phosphorothioate internucleotide linkages between nucleotide positions 1 and 2, and between nucleotide positions 2 and 3 (counting from the 5' end); and (b) an antisense strand having:
  (i) a length of 23 nucleotides;
  (ii) 2'-OMe modifications at positions 1, 3 to 5, 7, 10 to 13, 15, and 17 to 23, and 2'-F modifications at positions 2, 6, 8, 9, 14, and 16 (counting from the 5' end); and
  (iii) phosphorothioate internucleotide linkages between nucleotide positions 1 and 2, between nucleotide positions 2 and 3, between nucleotide positions 21 and 22, and between nucleotide positions 22 and 23 (counting from the 5' end);

wherein the dsRNA agents have a two nucleotide overhang at the 3'-end of the antisense strand, and a blunt end at the 5'-end of the antisense strand.

In another particular embodiment, the dsRNA agents of the present invention comprise:

(a) a sense strand having:
  (i) a length of 19 nucleotides;
  (ii) an ASGPR ligand attached to the 3'-end, wherein said ASGPR ligand comprises three GalNAc derivatives attached through a trivalent branched linker;
  (iii) 2'-OMe modifications at positions 1 to 4, 6, and 10 to 19, and 2'-F modifications at positions 5, and 7 to 9; and
  (iv) phosphorothioate internucleotide linkages between nucleotide positions 1 and 2, and between nucleotide positions 2 and 3 (counting from the 5' end); and (b) an antisense strand having:
  (i) a length of 21 nucleotides;
  (ii) 2'-OMe modifications at positions 1, 3 to 5, 7, 10 to 13, 15, and 17 to 21, and 2'-F modifications at positions 2, 6, 8, 9, 14, and 16 (counting from the 5' end); and
  (iii) phosphorothioate internucleotide linkages between nucleotide positions 1 and 2, between nucleotide positions 2 and 3, between nucleotide positions 19 and 20, and between nucleotide positions 20 and 21 (counting from the 5' end);

wherein the dsRNA agents have a two nucleotide overhang at the 3'-end of the antisense strand, and a blunt end at the 5'-end of the antisense strand.

In one embodiment, the dsRNA agents described herein further comprise a thermally destabilizing modification at position 7 counting from the 5'-end of the antisense from, at position 15 counting from the 5'-end of sense strand, position 21 counting from the 5'-end of the sense strand, or combinations thereof.

In one aspect, the invention relates to a dsRNA agent capable of inhibiting the expression of a target gene. The dsRNA agent comprises a sense strand and an antisense strand, each strand having 14 to 40 nucleotides. The sense strand contains at least one thermally destabilizing nucleotide, wherein at least one said thermally destabilizing nucleotide occurs at or near the site that is opposite to the seed region of the antisense strand (i.e. at position 2-8 of the 5'-end of the antisense strand), For example, the thermally destabilizing nucleotide occurs between positions 14-17 of the 5'-end of the sense strand when the sense strand is 21 nucleotides in length. The antisense strand comprises two modified nucleic acids that are smaller than a sterically demanding 2'-OMe modification separated by 11 nucleotides in length. For example, the two modified nucleic acids are at positions 2 and 14 of the 5'end of the antisense strand.

In one embodiment, the sense strand of the dsRNA agent further comprises an endonuclease susceptible modified nucleotide at the cleavage site of the sense strand. In one example, the endonuclease susceptible modified nucleotide is at position 11 from the 5' end of the sense strand.

In one embodiment, the antisense strand further comprises a third modified nucleotide that provides the nucleotide a steric bulk that is less or equal to the steric bulk of a 2'-OMe modification, and the third modified nucleotide is at positions 6-10 from the 5' end of the antisense strand. For example, the third modified nucleotide is at position 10 from the 5' end of the antisense strand.

The embodiments for the thermally destabilizing nucleotides are similar as the various embodiments described above for C1 in formula (I). The embodiments for the modified nucleic acids smaller than a sterically demanding 2'-OMe modification are similar as the various embodiments described above for T1', T2', and T3' in formula (I). The embodiments describing the lengths, overhangs, additional modifications, and ligand conjugations to the dsRNA agents of formula I above are suitable here.

The present invention further relates to a use of a dsRNA agent as defined herein for inhibiting expression of a target gene. In one embodiment, the present invention further relates to a use of a dsRNA agent for inhibiting expression of a target gene in vitro.

The present invention further relates to a dsRNA agent as defined herein for use in inhibiting expression of a target gene in a subject. The subject may be any animal, preferably a mammal, more preferably a mouse, a rat, a sheep, a cattle, a dog, a cat, or a human.

In one aspect, the invention relates to a dsRNA agent capable of inhibiting the expression of a target gene. The dsRNA agent comprises a sense strand and an antisense strand, each strand having 14 to 40 nucleotides. The sense strand comprises an endonuclease susceptible modified nucleotide (e.g., DNA, RNA, or 2'-F) near the cleavage site of the sense strand. For example, the endonuclease susceptible modified nucleotide is at position 11 from the 5' end of the sense strand. The endonuclease susceptible modification that occurs near the cleavage site can influence the susceptibility of the cleavage site. For example, thermally destabilizing modifications near the cleavage site can provide endonuclease susceptibility at the cleavage site. The antisense strand comprises two modified nucleic acids that are smaller than a sterically demanding 2'-OMe modification separated by 11 nucleotides in length. For example, the two modified nucleic acids are at positions 2 and 14 of the 5'end of the antisense strand.

In another aspect, the invention further provides a method for delivering the dsRNA agent of the invention to a specific target in a subject by subcutaneous or intravenous administration. The invention further provides the dsRNA agents of the invention for use in a method for delivering said agents to a specific target in a subject by subcutaneous or intravenous administration.

DETAILED DESCRIPTION

Figure 1:
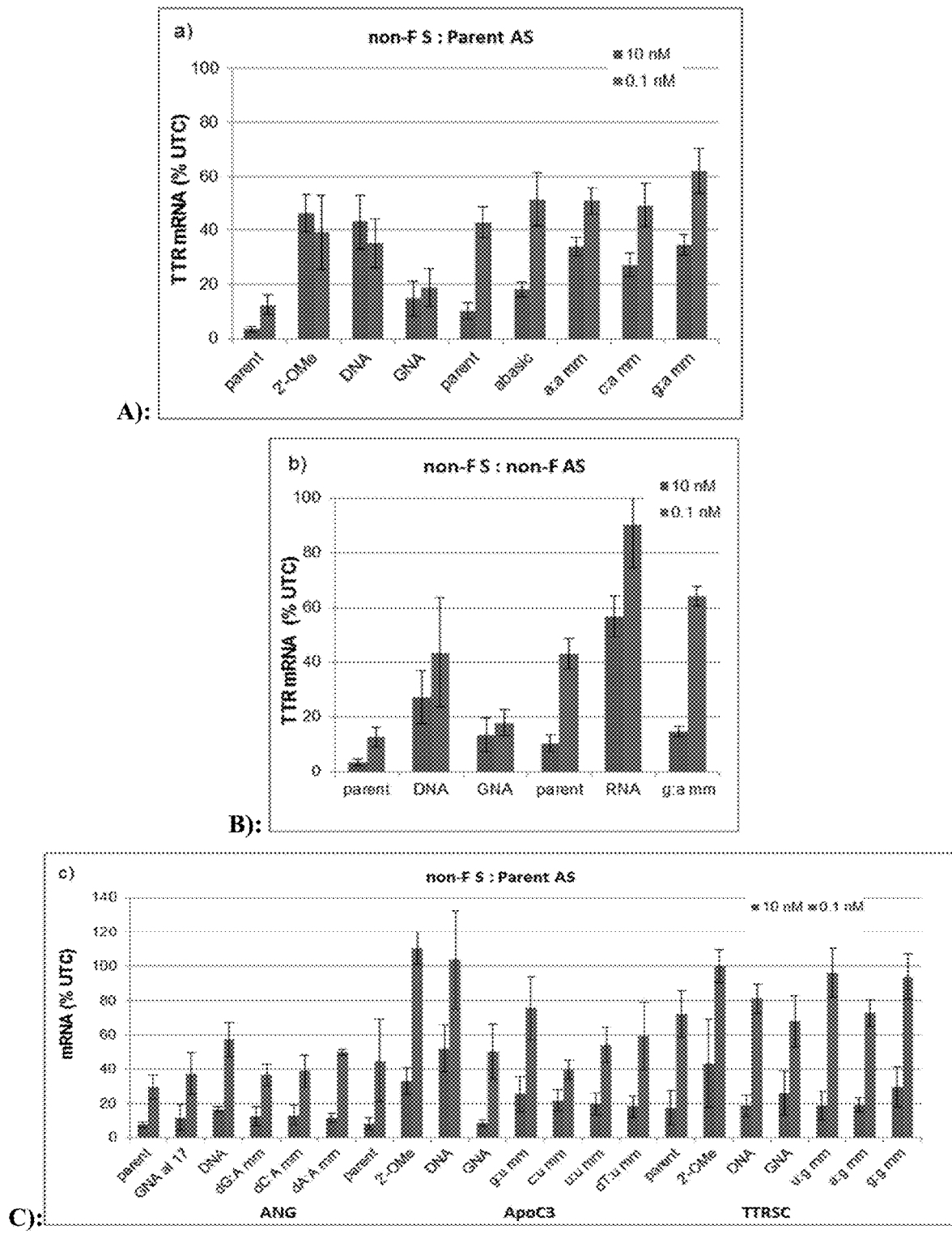
FIG. 1 shows charts showing the effect of different modifications at sense strand position 17 on in vitro efficacy evaluated at 10 nM and 0.1 nM concentration: (A) siRNAs targeting mTTR with non-F sense strand paired with parent AS-strand; (B) siRNAs targeting mTTR with non-F sense strand paired with non-F AS-strand; (C) siRNAs targeting ANG, ApoC3 and TTRSC with non-F sense strand paired with parent AS-strand.

The inventors found that having 2'-OMe modifications at nucleotide positions 2 and 14 from the 5'-end of the antisense strand dampened the gene silencing activity of a dsRNA agent. By introducing chemical modifications at the 2' position or equivalent positions in a non-ribose, acyclic or backbone that provide less steric bulk than a 2'-OMe modification at certain positions in antisense and/or sense strand, the dsRNA agents were able to regain the gene silencing activity. The inventors also determined that introducing a thermally destabilizing nucleotide on the sense strand at a site opposite to the seed region of the antisense strand (i.e. at position 2-8 of the 5'-end of the antisense strand) provides better gene silencing activity.

The sense strand and antisense strand of the dsRNA agent may be completely modified. The dsRNA agent optionally conjugates with an asialoglycoprotein receptor (ASGPR) ligand, for instance on the sense strand. The resulting dsRNA agents present effective in vivo gene silencing activity.

Accordingly, the invention provides a double-stranded RNAi (dsRNA) agent capable of inhibiting the expression of a target gene. The dsRNA agent comprises a sense strand and an antisense strand. Each strand of the dsRNA agent can range from 12-40 nucleotides in length. For example, each strand can be between 14-40 nucleotides in length, 17-37 nucleotides in length, 25-37 nucleotides in length, 27-30 nucleotides in length, 17-23 nucleotides in length, 17-21 nucleotides in length, 17-19 nucleotides in length, 19-25 nucleotides in length, 19-23 nucleotides in length, 19-21 nucleotides in length, 21-25 nucleotides in length, or 21-23 nucleotides in length.

The sense strand and antisense strand typically form a duplex dsRNA. The duplex region of a dsRNA agent may be 12-40 nucleotide pairs in length. For example, the duplex region can be between 14-40 nucleotide pairs in length, 17-30 nucleotide pairs in length, 25-35 nucleotides in length, 27-35 nucleotide pairs in length, 17-23 nucleotide pairs in length, 17-21 nucleotide pairs in length, 17-19 nucleotide pairs in length, 19-25 nucleotide pairs in length, 19-23 nucleotide pairs in length, 19-21 nucleotide pairs in length, 21-25 nucleotide pairs in length, or 21-23 nucleotide pairs in length. In another example, the duplex region is selected from 15, 16, 17, 18, 19, 20, 21, 22, 23, 24, 25, 26, and 27 nucleotide pairs in length.

In one embodiment, the dsRNA agent of the invention comprises one or more overhang regions and/or capping groups of dsRNA agent at the 3'-end, or 5'-end or both ends of a strand. The overhang can be 1-10 nucleotides in length, 1-6 nucleotides in length, for instance 2-6 nucleotides in length, 1-5 nucleotides in length, 2-5 nucleotides in length, 1-4 nucleotides in length, 2-4 nucleotides in length, 1-3 nucleotides in length, 2-3 nucleotides in length, or 1-2 nucleotides in length. The overhangs can be the result of one strand being longer than the other, or the result of two strands of the same length being staggered. The overhang can form a mismatch with the target mRNA or it can be complementary to the gene sequences being targeted or can be other sequence. The first and second strands can also be joined, e.g., by additional bases to form a hairpin, or by other non-base linkers.

In one embodiment, the nucleotides in the overhang region of the dsRNA agent of the invention can each independently be a modified or unmodified nucleotide including, but not limited to 2'-sugar modified, such as, 2-F 2'-Omethyl, thymidine (T), 2'-O-methoxyethyl-5-methyluridine (Teo), 2'-O-methoxyethyladenosine (Aeo), 2'-O-methoxyethyl-5-methylcytidine (m5Ceo), and any combinations thereof. For example, TT can be an overhang sequence for either end on either strand. The overhang can form a mismatch with the target mRNA or it can be complementary to the gene sequences being targeted or can be other sequence.

The 5'- or 3'-overhangs at the sense strand, antisense strand or both strands of the dsRNA agent of the invention may be phosphorylated. In some embodiments, the overhang region contains two nucleotides having a phosphorothioate between the two nucleotides, where the two nucleotides can be the same or different. In one embodiment, the overhang is present at the 3'-end of the sense strand, antisense strand or both strands. In one embodiment, this 3'-overhang is present in the antisense strand. In one embodiment, this 3'-overhang is present in the sense strand.

The dsRNA agent of the invention may comprise only a single overhang, which can strengthen the interference activity of the dsRNA, without affecting its overall stability. For example, the single-stranded overhang is located at the 3'-terminal end of the sense strand or, alternatively, at the 3'-terminal end of the antisense strand. The dsRNA may also have a blunt end, located at the 5'-end of the antisense strand (or the 3'-end of the sense strand) or vice versa. Generally, the antisense strand of the dsRNA has a nucleotide overhang at the 3'-end, and the 5'-end is blunt. While not bound by theory, the asymmetric blunt end at the 5'-end of the antisense strand and 3'-end overhang of the antisense strand favor the guide strand loading into RISC process. For example the single overhang comprises at least two, three, four, five, six, seven, eight, nine, or ten nucleotides in length.

In one embodiment, the dsRNA agent of the invention may also have two blunt ends, at both ends of the dsRNA duplex.

In one embodiment, the dsRNA agent of the invention is a double ended bluntmer of 19 nt in length, wherein the sense strand contains at least one thermally destabilizing nucleotide, where at least one thermally destabilizing nucleotide occurs at or near the site that is opposite to the seed region of the antisense strand (i.e. at position 2-8 of the 5'-end of the antisense strand), For example, the thermally destabilizing nucleotide occurs between positions 14-17 of the 5'-end of the sense strand. The antisense strand contains at least two modified nucleic acids that is smaller than a sterically demanding 2'-OMe; preferably, the two modified nucleic acids that is smaller than a sterically demanding 2'-OMe are at positions 2 and 14 of the 5'end of the antisense strand.

In one embodiment, the dsRNA agent of the invention is a double ended bluntmer of 20 nt in length, wherein the sense strand contains at least one thermally destabilizing nucleotide, where at least one thermally destabilizing nucleotide occurs at or near the site that is opposite to the seed region of the antisense strand (i.e. at position 2-8 of the 5'-end of the antisense strand), For example, the thermally destabilizing nucleotide occurs between positions 14-17 of the 5'-end of the sense strand. The antisense strand contains at least two modified nucleic acids that is smaller than a sterically demanding 2'-OMe; preferably, the two modified nucleic acids that is smaller than a sterically demanding 2'-OMe are at positions 2 and 14 of the 5'end of the antisense strand.

In one embodiment, the dsRNA agent of the invention is a double ended bluntmer of 21 nt in length, wherein the sense strand contains at least one thermally destabilizing nucleotide, where at least one thermally destabilizing nucleotide occurs at or near the site that is opposite to the seed region of the antisense strand (i.e. at position 2-8 of the 5'-end of the antisense strand), For example, the thermally destabilizing nucleotide occurs between positions 14-17 of the 5'-end of the sense strand. The antisense strand contains at least two modified nucleic acids that is smaller than a sterically demanding 2'-OMe; preferably, the two modified nucleic acids that is smaller than a sterically demanding 2'-OMe are at positions 2 and 14 of the 5' end of the antisense strand.

In one embodiment, the dsRNA agent of the invention comprises a 21 nucleotides (nt) sense strand and a 23 nucleotides (nt) antisense, wherein the sense strand contains at least one thermally destabilizing nucleotide, where at least one thermally destabilizing nucleotide occurs at or near the site that is opposite to the seed region of the antisense strand (i.e. at position 2-8 of the 5'-end of the antisense strand), For example, the thermally destabilizing nucleotide occurs between positions 14-17 of the 5'-end of the sense strand when the sense strand is 21 nucleotides in length. The antisense strand contains at least two modified nucleic acids that is smaller than a sterically demanding 2'-OMe; preferably, the two modified nucleic acids that is smaller than a sterically demanding 2'-OMe are at positions 2 and 14 of the 5'end of the antisense strand, wherein one end of the dsRNA is blunt, while the other end is comprises a 2 nt overhang. Preferably, the 2 nt overhang is at the 3'-end of the antisense. Optionally, the dsRNA further comprises a ligand (preferably a receptor ligand i.e. ASGPR ligand).

In one embodiment, the dsRNA agent of the invention comprising a sense and antisense strands, wherein: the sense strand is 25-30 nucleotide residues in length, wherein starting from the 5' terminal nucleotide (position 1), positions 1 to 23 of said sense strand comprise at least 8 ribonucleotides; antisense strand is 36-66 nucleotide residues in length and, starting from the 3' terminal nucleotide, at least 8 ribonucleotides in the positions paired with positions 1-23 of sense strand to form a duplex; wherein at least the 3' terminal nucleotide of antisense strand is unpaired with sense strand, and up to 6 consecutive 3' terminal nucleotides are unpaired with sense strand, thereby forming a 3' single stranded overhang of 1-6 nucleotides; wherein the 5' terminus of antisense strand comprises from 10-30 consecutive nucleotides which are unpaired with sense strand, thereby forming a 10-30 nucleotide single stranded 5' overhang; wherein at least the sense strand 5' terminal and 3' terminal nucleotides are base paired with nucleotides of antisense strand when sense and antisense strands are aligned for maximum complementarity, thereby forming a substantially duplexed region between sense and antisense strands; and antisense strand is sufficiently complementary to a target RNA along at least 19 ribonucleotides of antisense strand length to reduce target gene expression when said double stranded nucleic acid is introduced into a mammalian cell; and wherein the sense strand contains at least one thermally destabilizing nucleotide, where at least one thermally destabilizing nucleotide occurs at or near the site that is opposite to the seed region of the antisense strand (i.e. at position 2-8 of the 5'-end of the antisense strand), For example, the thermally destabilizing nucleotide occurs between positions 14-17 of the 5'-end of the sense strand. The antisense strand contains at least two modified nucleic acids that are smaller than a sterically demanding 2'-OMe; preferably, the two modified nucleic acids that are smaller than a sterically demanding 2'-OMe are at positions 2 and 14 of the 5'end of the antisense strand.

In one embodiment, the dsRNA agent of the invention comprises a sense and antisense strands, wherein said dsRNA agent comprises a sense strand having a length which is at least 25 and at most 29 nucleotides and an antisense strand having a length which is at most 30 nucleotides with the sense strand comprises a modified nucleotide that is susceptible to enzymatic degradation at position 11 from the 5'end. The antisense strand comprises two modified nucleic acids that are smaller than a sterically demanding 2'-OMe are at positions 2 and 14 of the 5' end of the antisense strand; wherein said 3' end of said sense strand and said 5' end of said antisense strand form a blunt end and said antisense strand is 1-4 nucleotides longer at its 3' end than the sense strand, wherein the duplex region which is at least 25 nucleotides in length, and said antisense strand is sufficiently complementary to a target mRNA along at least 19 nt of said antisense strand length to reduce target gene expression when said dsRNA agent is introduced into a mammalian cell, and wherein dicer cleavage of said dsRNA preferentially results in an siRNA comprising said 3' end of said antisense strand, thereby reducing expression of the target gene in the mammal. Optionally, the dsRNA agent further comprises a ligand.

In one embodiment, the sense strand comprises a modified nucleotide that is susceptible to enzymatic degradation at position 11 from the 5'end. The antisense strand comprises two modified nucleic acids that are smaller than a sterically demanding 2'-OMe are at positions 2 and 14 of the 5' end of the antisense strand.

In one embodiment, the antisense strand comprises two modified nucleic acids that are smaller than a sterically demanding 2'-OMe are at positions 2 and 14 of the 5'end of the antisense strand.

In one embodiment, every nucleotide in the sense strand and antisense strand of the dsRNA agent may be modified. Each nucleotide may be modified with the same or different modification which can include one or more alteration of one or both of the non-linking phosphate oxygens and/or of one or more of the linking phosphate oxygens; alteration of a constituent of the ribose sugar, e.g., of the 2' hydroxyl on the ribose sugar; wholesale replacement of the phosphate moiety with "dephospho" linkers; modification or replacement of a naturally occurring base; and replacement or modification of the ribose-phosphate backbone.

As nucleic acids are polymers of subunits, many of the modifications occur at a position which is repeated within a nucleic acid, e.g., a modification of a base, or a phosphate moiety, or a non-linking O of a phosphate moiety. In some cases the modification will occur at all of the subject positions in the nucleic acid but in many cases it will not. By way of example, a modification may only occur at a 3' or 5' terminal position, may only occur in a terminal region, e.g., at a position on a terminal nucleotide or in the last 2, 3, 4, 5, or 10 nucleotides of a strand. A modification may occur in a double strand region, a single strand region, or in both. A modification may occur only in the double strand region of a RNA or may only occur in a single strand region of a RNA. E.g., a phosphorothioate modification at a non-linking O position may only occur at one or both termini, may only occur in a terminal region, e.g., at a position on a terminal nucleotide or in the last 2, 3, 4, 5, or 10 nucleotides of a strand, or may occur in double strand and single strand regions, particularly at termini. The 5' end or ends can be phosphorylated.

It may be possible, e.g., to enhance stability, to include particular bases in overhangs, or to include modified nucleotides or nucleotide surrogates, in single strand overhangs, e.g., in a 5' or 3' overhang, or in both. E.g., it can be desirable to include purine nucleotides in overhangs. In some embodiments all or some of the bases in a 3' or 5' overhang may be modified, e.g., with a modification described herein. Modifications can include, e.g., the use of modifications at the 2' position of the ribose sugar with modifications that are known in the art, e.g., the use of deoxyribonucleotides, 2'-deoxy-2'-fluoro (2'-F) or 2'—O-methyl modified instead of the ribosugar of the nucleobase, and modifications in the phosphate group, e.g., phosphorothioate modifications. Overhangs need not be homologous with the target sequence.

In one embodiment, each residue of the sense strand and antisense strand is independently modified with LNA, HNA, CeNA, 2'-methoxyethyl, 2'-O-methyl, 2'-O-allyl, 2'—C-allyl, 2'-deoxy, or 2'-fluoro. The strands can contain more than one modification. In one embodiment, each residue of the sense strand and antisense strand is independently modified with 2'-O-methyl or 2'-fluoro.

At least two different modifications are typically present on the sense strand and antisense strand. Those two modifications may be the 2'-deoxy, 2'-O-methyl or 2'-fluoro modifications, acyclic nucleotides or others.

In one embodiment, the sense strand and antisense strand each comprises two differently modified nucleotides selected from 2'-O-methyl or 2'-deoxy.

In one embodiment, each residue of the sense strand and antisense strand is independently modified with 2'-O-methyl nucleotide, 2'-deoxy nucleotide, 2'-deoxyfluoro nucleotide, 2'-O—N-methylacetamido (2'-O—NMA) nucleotide, a 2'-O-dimethylaminoethoxyethyl (2'-O-DMAEOE) nucleotide, 2'-O-aminopropyl (2'-O-AP) nucleotide, or 2'-ara-F nucleotide.

In one embodiment, the dsRNA agent of the invention comprises modifications of an alternating pattern, particular in the B1, B2, B3, B1', B2', B3', B4' regions, as shown in formula I. The term "alternating motif" or "alternative pattern" as used herein refers to a motif having one or more modifications, each modification occurring on alternating nucleotides of one strand. The alternating nucleotide may refer to one per every other nucleotide or one per every three nucleotides, or a similar pattern. For example, if A, B and C each represent one type of modification to the nucleotide, the alternating motif can be "ABABABABABAB . . . ," "AABBAABBAABB . . . ," "AABAABAABAAB . . . ," "AAABAAAAB . . . ," "AAABBBAAABBB . . . ," or "ABCABCABCABC . . . ," etc.

The type of modifications contained in the alternating motif may be the same or different. For example, if A, B, C, D each represent one type of modification on the nucleotide, the alternating pattern, i.e., modifications on every other nucleotide, may be the same, but each of the sense strand or antisense strand can be selected from several possibilities of modifications within the alternating motif such as "ABABAB . . . ", "ACACAC . . . " "BDBDBD . . . " or "CDCDCD . . . ," etc.

In one embodiment, the dsRNA agent of the invention comprises the modification pattern for the alternating motif on the sense strand relative to the modification pattern for the alternating motif on the antisense strand is shifted. The shift may be such that the modified group of nucleotides of the sense strand corresponds to a differently modified group of nucleotides of the antisense strand and vice versa. For example, the sense strand when paired with the antisense strand in the dsRNA duplex, the alternating motif in the sense strand may start with "ABABAB" from 5'-3' of the strand and the alternating motif in the antisense strand may start with "BABABA" from 3'-5' of the strand within the duplex region. As another example, the alternating motif in the sense strand may start with "AABBAABB" from 5'-3' of the strand and the alternating motif in the antisense strand may start with "BBAABBAA" from 3'-5' of the strand within the duplex region, so that there is a complete or partial shift of the modification patterns between the sense strand and the antisense strand.

The dsRNA agent of the invention may further comprise at least one phosphorothioate or methylphosphonate internucleotide linkage. The phosphorothioate or methylphosphonate internucleotide linkage modification may occur on any nucleotide of the sense strand or antisense strand or both in any position of the strand. For instance, the internucleotide linkage modification may occur on every nucleotide on the sense strand and/or antisense strand; each internucleotide linkage modification may occur in an alternating pattern on the sense strand or antisense strand; or the sense strand or antisense strand comprises both internucleotide linkage modifications in an alternating pattern. The alternating pattern of the internucleotide linkage modification on the sense strand may be the same or different from the antisense strand, and the alternating pattern of the internucleotide linkage modification on the sense strand may have a shift relative to the alternating pattern of the internucleotide linkage modification on the antisense strand.

In one embodiment, the dsRNA agent comprises the phosphorothioate or methylphosphonate internucleotide linkage modification in the overhang region. For example, the overhang region comprises two nucleotides having a phosphorothioate or methylphosphonate internucleotide linkage between the two nucleotides. Internucleotide linkage modifications also may be made to link the overhang nucleotides with the terminal paired nucleotides within duplex region. For example, at least 2, 3, 4, or all the overhang nucleotides may be linked through phosphorothioate or methylphosphonate internucleotide linkage, and optionally, there may be additional phosphorothioate or methylphosphonate internucleotide linkages linking the overhang nucleotide with a paired nucleotide that is next to the overhang nucleotide. For instance, there may be at least two phosphorothioate internucleotide linkages between the terminal three nucleotides, in which two of the three nucleotides are overhang nucleotides, and the third is a paired nucleotide next to the overhang nucleotide. Preferably, these terminal three nucleotides may be at the 3'-end of the antisense strand.

In one embodiment, the sense strand of the dsRNA agent comprises 1-10 blocks of two to ten phosphorothioate or methylphosphonate internucleotide linkages separated by 1, 2, 3, 4, 5, 6, 7, 8, 9, 10, 11, 12, 13, 14, 15 or 16 phosphate internucleotide linkages, wherein one of the phosphorothioate or methylphosphonate internucleotide linkages is placed at any position in the oligonucleotide sequence and the said sense strand is paired with an antisense strand comprising any combination of phosphorothioate, methylphosphonate and phosphate internucleotide linkages or an antisense strand comprising either phosphorothioate or methylphosphonate or phosphate linkage.

In one embodiment, the antisense strand of the dsRNA agent comprises two blocks of two phosphorothioate or methylphosphonate internucleotide linkages separated by 1, 2, 3, 4, 5, 6, 7, 8, 9, 10, 11, 12, 13, 14, 15, 16, 17, or 18 phosphate internucleotide linkages, wherein one of the phosphorothioate or methylphosphonate internucleotide linkages is placed at any position in the oligonucleotide sequence and the said antisense strand is paired with a sense strand comprising any combination of phosphorothioate, methylphosphonate and phosphate internucleotide linkages or an antisense strand comprising either phosphorothioate or methylphosphonate or phosphate linkage.

In one embodiment, the antisense strand of the dsRNA agent comprises two blocks of three phosphorothioate or methylphosphonate internucleotide linkages separated by 1, 2, 3, 4, 5, 6, 7, 8, 9, 10, 11, 12, 13, 14, 15 or 16 phosphate internucleotide linkages, wherein one of the phosphorothioate or methylphosphonate internucleotide linkages is placed at any position in the oligonucleotide sequence and the said antisense strand is paired with a sense strand comprising any combination of phosphorothioate, methylphosphonate and phosphate internucleotide linkages or an antisense strand comprising either phosphorothioate or methylphosphonate or phosphate linkage.

In one embodiment, the antisense strand of the dsRNA agent comprises two blocks of four phosphorothioate or methylphosphonate internucleotide linkages separated by 1, 2, 3, 4, 5, 6, 7, 8, 9, 10, 11, 12, 13 or 14 phosphate internucleotide linkages, wherein one of the phosphorothioate or methylphosphonate internucleotide linkages is placed at any position in the oligonucleotide sequence and the said antisense strand is paired with a sense strand comprising any combination of phosphorothioate, methylphosphonate and phosphate internucleotide linkages or an antisense strand comprising either phosphorothioate or methylphosphonate or phosphate linkage.

In one embodiment, the antisense strand of the dsRNA agent comprises two blocks of five phosphorothioate or methylphosphonate internucleotide linkages separated by 1, 2, 3, 4, 5, 6, 7, 8, 9, 10, 11 or 12 phosphate internucleotide linkages, wherein one of the phosphorothioate or methylphosphonate internucleotide linkages is placed at any position in the oligonucleotide sequence and the said antisense strand is paired with a sense strand comprising any combination of phosphorothioate, methylphosphonate and phosphate internucleotide linkages or an antisense strand comprising either phosphorothioate or methylphosphonate or phosphate linkage.

In one embodiment, the antisense strand of the dsRNA agent comprises two blocks of six phosphorothioate or methylphosphonate internucleotide linkages separated by 1, 2, 3, 4, 5, 6, 7, 8, 9 or 10 phosphate internucleotide linkages, wherein one of the phosphorothioate or methylphosphonate internucleotide linkages is placed at any position in the oligonucleotide sequence and the said antisense strand is paired with a sense strand comprising any combination of phosphorothioate, methylphosphonate and phosphate internucleotide linkages or an antisense strand comprising either phosphorothioate or methylphosphonate or phosphate linkage.

In one embodiment, the antisense strand of the dsRNA agent comprises two blocks of seven phosphorothioate or methylphosphonate internucleotide linkages separated by 1, 2, 3, 4, 5, 6, 7 or 8 phosphate internucleotide linkages, wherein one of the phosphorothioate or methylphosphonate internucleotide linkages is placed at any position in the oligonucleotide sequence and the said antisense strand is paired with a sense strand comprising any combination of phosphorothioate, methylphosphonate and phosphate internucleotide linkages or an antisense strand comprising either phosphorothioate or methylphosphonate or phosphate linkage.

In one embodiment, the antisense strand of the dsRNA agent comprises two blocks of eight phosphorothioate or methylphosphonate internucleotide linkages separated by 1, 2, 3, 4, 5 or 6 phosphate internucleotide linkages, wherein one of the phosphorothioate or methylphosphonate internucleotide linkages is placed at any position in the oligonucleotide sequence and the said antisense strand is paired with a sense strand comprising any combination of phosphorothioate, methylphosphonate and phosphate internucleotide linkages or an antisense strand comprising either phosphorothioate or methylphosphonate or phosphate linkage.

In one embodiment, the antisense strand of the dsRNA agent comprises two blocks of nine phosphorothioate or methylphosphonate internucleotide linkages separated by 1, 2, 3 or 4 phosphate internucleotide linkages, wherein one of the phosphorothioate or methylphosphonate internucleotide linkages is placed at any position in the oligonucleotide sequence and the said antisense strand is paired with a sense strand comprising any combination of phosphorothioate, methylphosphonate and phosphate internucleotide linkages or an antisense strand comprising either phosphorothioate or methylphosphonate or phosphate linkage.

In one embodiment, the dsRNA agent of the invention further comprises one or more phosphorothioate or methylphosphonate internucleotide linkage modification within 1-10 of the termini position(s) of the sense and/or antisense strand. For example, at least 2, 3, 4, 5, 6, 7, 8, 9 or 10 nucleotides may be linked through phosphorothioate or methylphosphonate internucleotide linkage at one end or both ends of the sense and/or antisense strand.

In one embodiment, the dsRNA agent of the invention further comprises one or more phosphorothioate or methylphosphonate internucleotide linkage modification within 1-10 of the internal region of the duplex of each of the sense and/or antisense strand. For example, at least 2, 3, 4, 5, 6, 7, 8, 9 or 10 nucleotides may be linked through phosphorothioate methylphosphonate internucleotide linkage at position 8-16 of the duplex region counting from the 5'-end of the sense strand; the dsRNA agent can optionally further comprise one or more phosphorothioate or methylphosphonate internucleotide linkage modification within 1-10 of the termini position(s).

In one embodiment, the dsRNA agent of the invention further comprises one to five phosphorothioate or methylphosphonate internucleotide linkage modification(s) within position 1-5 and one to five phosphorothioate or methylphosphonate internucleotide linkage modification(s) within position 18-23 of the sense strand (counting from the 5'-end), and one to five phosphorothioate or methylphosphonate internucleotide linkage modification at positions 1 and 2 and one to five within positions 18-23 of the antisense strand (counting from the 5'-end).

In one embodiment, the dsRNA agent of the invention further comprises one phosphorothioate internucleotide linkage modification within position 1-5 and one phosphorothioate or methylphosphonate internucleotide linkage modification within position 18-23 of the sense strand (counting from the 5'-end), and one phosphorothioate internucleotide linkage modification at positions 1 and 2 and two phosphorothioate or methylphosphonate internucleotide linkage modifications within positions 18-23 of the antisense strand (counting from the 5'-end).

In one embodiment, the dsRNA agent of the invention further comprises two phosphorothioate internucleotide linkage modifications within position 1-5 and one phosphorothioate internucleotide linkage modification within position 18-23 of the sense strand (counting from the 5'-end), and one phosphorothioate internucleotide linkage modification at positions 1 and 2 and two phosphorothioate internucleotide linkage modifications within positions 18-23 of the antisense strand (counting from the 5'-end).

In one embodiment, the dsRNA agent of the invention further comprises two phosphorothioate internucleotide linkage modifications within position 1-5 and two phosphorothioate internucleotide linkage modifications within position 18-23 of the sense strand (counting from the 5'-end), and one phosphorothioate internucleotide linkage modification at positions 1 and 2 and two phosphorothioate internucleotide linkage modifications within positions 18-23 of the antisense strand (counting from the 5'-end).

In one embodiment, the dsRNA agent of the invention further comprises two phosphorothioate internucleotide linkage modifications within position 1-5 and two phosphorothioate internucleotide linkage modifications within position 18-23 of the sense strand (counting from the 5'-end), and one phosphorothioate internucleotide linkage modification at positions 1 and 2 and one phosphorothioate internucleotide linkage modification within positions 18-23 of the antisense strand (counting from the 5'-end).

In one embodiment, the dsRNA agent of the invention further comprises one phosphorothioate internucleotide linkage modification within position 1-5 and one phosphorothioate internucleotide linkage modification within position 18-23 of the sense strand (counting from the 5'-end), and two phosphorothioate internucleotide linkage modifications at positions 1 and 2 and two phosphorothioate internucleotide linkage modifications within positions 18-23 of the antisense strand (counting from the 5'-end).

In one embodiment, the dsRNA agent of the invention further comprises one phosphorothioate internucleotide linkage modification within position 1-5 and one within position 18-23 of the sense strand (counting from the 5'-end), and two phosphorothioate internucleotide linkage modification at positions 1 and 2 and one phosphorothioate internucleotide linkage modification within positions 18-23 of the antisense strand (counting from the 5'-end).

In one embodiment, the dsRNA agent of the invention further comprises one phosphorothioate internucleotide linkage modification within position 1-5 (counting from the 5'-end) of the sense strand, and two phosphorothioate internucleotide linkage modifications at positions 1 and 2 and one phosphorothioate internucleotide linkage modification within positions 18-23 of the antisense strand (counting from the 5'-end).

In one embodiment, the dsRNA agent of the invention further comprises two phosphorothioate internucleotide linkage modifications within position 1-5 (counting from the 5'-end) of the sense strand, and one phosphorothioate internucleotide linkage modification at positions 1 and 2 and two phosphorothioate internucleotide linkage modifications within positions 18-23 of the antisense strand (counting from the 5'-end).

In one embodiment, the dsRNA agent of the invention further comprises two phosphorothioate internucleotide linkage modifications within position 1-5 and one within position 18-23 of the sense strand (counting from the 5'-end), and two phosphorothioate internucleotide linkage modifications at positions 1 and 2 and one phosphorothioate internucleotide linkage modification within positions 18-23 of the antisense strand (counting from the 5'-end).

In one embodiment, the dsRNA agent of the invention further comprises two phosphorothioate internucleotide linkage modifications within position 1-5 and one phosphorothioate internucleotide linkage modification within position 18-23 of the sense strand (counting from the 5'-end), and two phosphorothioate internucleotide linkage modifications at positions 1 and 2 and two phosphorothioate internucleotide linkage modifications within positions 18-23 of the antisense strand (counting from the 5'-end).

In one embodiment, the dsRNA agent of the invention further comprises two phosphorothioate internucleotide linkage modifications within position 1-5 and one phosphorothioate internucleotide linkage modification within position 18-23 of the sense strand (counting from the 5'-end), and one phosphorothioate internucleotide linkage modification at positions 1 and 2 and two phosphorothioate internucleotide linkage modifications within positions 18-23 of the antisense strand (counting from the 5'-end).

In one embodiment, the dsRNA agent of the invention further comprises two phosphorothioate internucleotide linkage modifications at position 1 and 2, and two phosphorothioate internucleotide linkage modifications at position 20 and 21 of the sense strand (counting from the 5'-end), and one phosphorothioate internucleotide linkage modification at positions 1 and one at position 21 of the antisense strand (counting from the 5'-end).

In one embodiment, the dsRNA agent of the invention further comprises one phosphorothioate internucleotide linkage modification at position 1, and one phosphorothioate internucleotide linkage modification at position 21 of the sense strand (counting from the 5'-end), and two phosphorothioate internucleotide linkage modifications at positions 1 and 2 and two phosphorothioate internucleotide linkage modifications at positions 20 and 21 the antisense strand (counting from the 5'-end).

In one embodiment, the dsRNA agent of the invention further comprises two phosphorothioate internucleotide linkage modifications at position 1 and 2, and two phosphorothioate internucleotide linkage modifications at position 21 and 22 of the sense strand (counting from the 5'-end), and one phosphorothioate internucleotide linkage modification at positions 1 and one phosphorothioate internucleotide linkage modification at position 21 of the antisense strand (counting from the 5'-end).

In one embodiment, the dsRNA agent of the invention further comprises one phosphorothioate internucleotide linkage modification at position 1, and one phosphorothioate internucleotide linkage modification at position 21 of the sense strand (counting from the 5'-end), and two phosphorothioate internucleotide linkage modifications at positions 1 and 2 and two phosphorothioate internucleotide linkage modifications at positions 21 and 22 the antisense strand (counting from the 5'-end).

In one embodiment, the dsRNA agent of the invention further comprises two phosphorothioate internucleotide linkage modifications at positions 1 and 2, and two phosphorothioate internucleotide linkage modifications at position 22 and 23 of the sense strand (counting from the 5'-end), and one phosphorothioate internucleotide linkage modification at positions 1 and one phosphorothioate internucleotide linkage modification at position 21 of the antisense strand (counting from the 5'-end).

In one embodiment, the dsRNA agent of the invention further comprises one phosphorothioate internucleotide linkage modification at position 1, and one phosphorothioate internucleotide linkage modification at position 21 of the sense strand (counting from the 5'-end), and two phosphorothioate internucleotide linkage modifications at positions 1 and 2 and two phosphorothioate internucleotide linkage modifications at positions 23 and 23 the antisense strand (counting from the 5'-end).

In one embodiment, the dsRNA agent of the invention comprises mismatch(es) with the target, within the duplex, or combinations thereof. The mismatch can occur in the overhang region or the duplex region. The base pair can be ranked on the basis of their propensity to promote dissociation or melting (e.g., on the free energy of association or dissociation of a particular pairing, the simplest approach is to examine the pairs on an individual pair basis, though next neighbor or similar analysis can also be used). In terms of promoting dissociation: A:U is preferred over G:C; G:U is preferred over G:C; and I:C is preferred over G:C (I=inosine). Mismatches, e.g., non-canonical or other than canonical pairings (as described elsewhere herein) are preferred over canonical (A:T, A:U, G:C) pairings; and pairings which include a universal base are preferred over canonical pairings.

In one embodiment, the dsRNA agent of the invention comprises at least one of the first 1, 2, 3, 4, or 5 base pairs within the duplex regions from the 5'-end of the antisense strand can be chosen independently from the group of: A:U, G:U, I:C, and mismatched pairs, e.g., non-canonical or other than canonical pairings or pairings which include a universal base, to promote the dissociation of the antisense strand at the 5'-end of the duplex.

In one embodiment, the nucleotide at the 1 position within the duplex region from the 5'-end in the antisense strand is selected from the group consisting of A, dA, dU, U, and dT. Alternatively, at least one of the first 1, 2 or 3 base pair within the duplex region from the 5'-end of the antisense strand is an AU base pair. For example, the first base pair within the duplex region from the 5'-end of the antisense strand is an AU base pair.

The inventors found that introducing 4'-modified and/or 5'-modified nucleotide to the 3'-end of a phosphodiester (PO), phosphorothioate (PS), and/or phosphorodithioate ($PS_2$) linkage of a dinucleotide at any position of single stranded or double stranded oligonucleotide can exert steric effect to the internucleotide linkage and, hence, protecting or stabilizing it against nucleases.

In one embodiment, 5'-modified nucleoside is introduced at the 3'-end of a dinucleotide at any position of single stranded or double stranded siRNA. For instance, a 5'-alkylated nucleoside may be introduced at the 3'-end of a dinucleotide at any position of single stranded or double stranded siRNA. The alkyl group at the 5' position of the ribose sugar can be racemic or chirally pure R or S isomer. An exemplary 5'-alkylated nucleoside is 5'-methyl nucleoside. The 5'-methyl can be either racemic or chirally pure R or S isomer.

In one embodiment, 4'-modified nucleoside is introduced at the 3'-end of a dinucleotide at any position of single stranded or double stranded siRNA. For instance, a 4'-alkylated nucleoside may be introduced at the 3'-end of a dinucleotide at any position of single stranded or double stranded siRNA. The alkyl group at the 4' position of the ribose sugar can be racemic or chirally pure R or S isomer. An exemplary 4'-alkylated nucleoside is 4'-methyl nucleoside. The 4'-methyl can be either racemic or chirally pure R or S isomer. Alternatively, a 4'-O-alkylated nucleoside may be introduced at the 3'-end of a dinucleotide at any position of single stranded or double stranded siRNA. The 4'-O-alkyl of the ribose sugar can be racemic or chirally pure R or S isomer. An exemplary 4'-O-alkylated nucleoside is 4'-O-methyl nucleoside. The 4'-O-methyl can be either racemic or chirally pure R or S isomer.

In one embodiment, 5'-alkylated nucleoside is introduced at any position on the sense strand or antisense strand of a dsRNA, and such modification maintains or improves potency of the dsRNA. The 5'-alkyl can be either racemic or chirally pure R or S isomer. An exemplary 5'-alkylated nucleoside is 5'-methyl nucleoside. The 5'-methyl can be either racemic or chirally pure R or S isomer.

In one embodiment, 4'-alkylated nucleoside is introduced at any position on the sense strand or antisense strand of a dsRNA, and such modification maintains or improves potency of the dsRNA. The 4'-alkyl can be either racemic or chirally pure R or S isomer. An exemplary 4'-alkylated nucleoside is 4'-methyl nucleoside. The 4'-methyl can be either racemic or chirally pure R or S isomer.

In one embodiment, 4'-O-alkylated nucleoside is introduced at any position on the sense strand or antisense strand of a dsRNA, and such modification maintains or improves potency of the dsRNA. The 5'-alkyl can be either racemic or chirally pure R or S isomer. An exemplary 4'-O-alkylated nucleoside is 4'-O-methyl nucleoside. The 4'-O-methyl can be either racemic or chirally pure R or S isomer.

In one embodiment, the sense strand sequence of the dsRNA agent is represented by formula (Is):

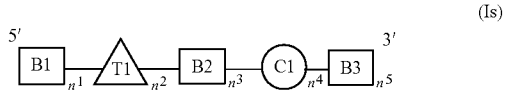

(Is)

wherein:

B 1, B2, and B3 each independently represent a nucleotide containing a modification selected from the group consisting of 2'-Oalkyl, 2'-substituted alkoxy, 2'-substituted alkyl, 2'-halo, ENA, and BNA/LNA;

C1 is a thermally destabilizing nucleotide (e.g., acyclic nucleotide such as UNA or GNA, mismatch, abasic, or DNA) placed at the opposite of the antisense seed region (i.e., positions 2-8 of the 5'-end of the antisense strand);

T1 represents a nucleotide comprising a chemical modification at the 2' position or equivalent position in a non-ribose, acyclic or backbone that provide the nucleotide a less steric bulk than a 2'-OMe modification; for example, T1 is selected from the group consisting of DNA, RNA, LNA, 2'-F, and 2'-F-5'-methyl;

$n^1$ or $n^3$ is independently 4 to 15 nucleotides in length;

$n^5$ is 1-6 nucleotide(s) in length;

$n^4$ is 1-3 nucleotide(s) in length; alternatively $n^4$ is 0, and $n^2$ is 0-3 nucleotide(s) in length.

In one embodiment, the sense strand sequence having 19, 20, 21, or 22 nucleotides in length of the dsRNA agent is represented by formula (Is):

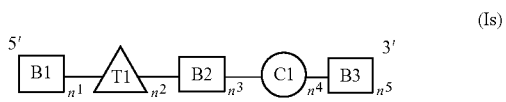

(Is)

wherein:

B 1, B2, and B3 each independently represent a nucleotide containing a modification selected from the group consisting of 2'-Oalkyl, 2'-substituted alkoxy, 2'-substituted alkyl, 2'-halo, ENA, and BNA/LNA;

C1 is a thermally destabilizing nucleotide (e.g., acyclic nucleotide such as UNA or GNA, mismatch, abasic, or DNA) placed at the opposite of the antisense seed region (i.e., positions 2-8 of the 5'-end of the antisense strand);

T1 represents a nucleotide comprising a chemical modification selected from the group consisting of DNA, RNA, LNA, 2'-F, and 2'-F-5'-methyl;

$n^1$ or $n^3$ is independently 4 to 15 nucleotides in length;

$n^5$ is 1-6 nucleotide(s) in length;

$n^4$ is 1-3 nucleotide(s) in length; alternatively $n^4$ is 0 and $n^2$ is 0-3 nucleotide(s) in length.

In one embodiment, the dsRNA agent of formula (Is) further comprises 3' and/or 5' overhang(s) of 1-10 nucleotides in length. In one example, the dsRNA agent of formula (Is) comprises a 5' overhang.

In one embodiment, C1 comprises one thermally destabilizing nucleotide at position 14, 15, 16 or 17 from the 5'-end of the sense strand. For example, C1 is an acyclic nucleotide (e.g., UNA or GNA), mismatch, abasic, or DNA. In one specific example, C1 is a GNA.

In one embodiment, T1 comprises a DNA, RNA, LNA, 2'-F, or 2'-F-5'-methyl at position 11 from the 5'-end of the sense strand.

In one embodiment, the dsRNA agent of the invention comprises a sense strand (Is), wherein C1 is an acyclic nucleotide (e.g., UNA or GNA), mismatch, abasic, or DNA; and T1 comprises a DNA, RNA, LNA, 2'-F, or 2'-F-5'-methyl at position 11 from the 5'-end of the sense strand.

In one embodiment, the antisense strand sequence of the dsRNA agent is represented by formula (Ia):

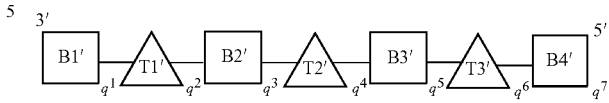

(Ia)

wherein:

B1', B2', B3', and B4' each independently represent a nucleotide containing a modification selected from the group consisting of 2'-Oalkyl, 2'-substituted alkoxy, 2'-substituted alkyl, 2'-halo, ENA, and BNA/LNA;

T1', T2', and T3' each independently represent a nucleotide comprising a chemical modification at the 2' position or equivalent position in a non-ribose, acyclic or backbone that provide the nucleotide a less steric bulk than a 2'-OMe modification; for example, T1', T2', and T3' each are independently selected from the group consisting of DNA, RNA, LNA, 2'-F, and 2'-F-5'-methyl;

$q^1$ is independently 4 to 15 nucleotides in length;

$q^3$ or $q^7$ is independently 1-6 nucleotide(s) in length;

$q^2$ or $q^6$ is independently 1-3 nucleotide(s) in length;

$q^4$ is independently 0-3 nucleotide(s) in length; and $q^5$ is independently 0-10 nucleotide(s) in length.

In one embodiment, the antisense strand sequence having 19, 20, 21, 22, 23, 24, or 25 nucleotides in length of the dsRNA agent is represented by formula (Ia):

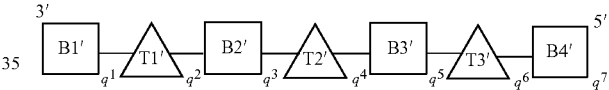

(Ia)

wherein:

B1', B2', B3', and B4' each independently represent a nucleotide containing a modification selected from the group consisting of 2'-Oalkyl, 2'-substituted alkoxy, 2'-substituted alkyl, 2'-halo, ENA, and BNA/LNA;

T1', T2', and T3' each independently represent a nucleotide comprising a chemical modification selected from the group consisting of DNA, RNA, LNA, 2'-F, and 2'-F-5'-methyl;

$q^1$ is independently 4 to 15 nucleotides in length;

$q^3$ or $q^7$ is independently 1-6 nucleotide(s) in length;

$q^2$ or $q^6$ is independently 1-3 nucleotide(s) in length;

$q^4$ is independently 0-3 nucleotide(s) in length; and $q^5$ is independently 0-10 nucleotide(s) in length.

In one embodiment, dsRNA of formula (Ia) further comprises 3' and/or 5' overhang(s) of 1-10 nucleotides in length. In one example, dsRNA of formula (Ia) comprises a 3' overhang.

In one embodiment, the invention relates to a double-stranded RNA (dsRNA) agent for inhibiting the expression of a target gene. The dsRNA agent comprises a sense strand and an antisense strand, each strand having 14 to 40 nucleotides:

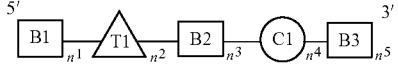

(I)

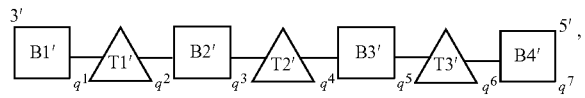

wherein:

B1, B2, B3, B1', B2', B3', and B4' each independently represent a nucleotide containing a modification selected from the group consisting of 2'-Oalkyl, 2'-substituted alkoxy, 2'-substituted alkyl, 2'-halo, ENA, and BNA/LNA;

C1 is an acyclic nucleotide (e.g., UNA or GNA);

T1, T1', T2', and T3' each independently represent a nucleotide comprising a chemical modification selected from the group consisting of DNA, RNA, LNA, 2'-F, and 2'-F-5'-methyl;

$n^1$, $n^3$, or $q^1$ is independently 4 to 15 nucleotides in length;

$n^5$, $q^3$ or $q^7$ is independently 1-6 nucleotide(s) in length;

$n^4$, $q^2$ or $q^6$ is independently 1-3 nucleotide(s) in length; alternatively $n^4$ is 0, $n^2$ or $q^4$ is independently 0-3 nucleotide(s) in length;

$q^5$ is independently 0-10 nucleotide(s) in length; and wherein the dsRNA agent has 3' and/or 5' overhang(s) of 1-10 nucleotides in length of the antisense and/or sense strand(s).

In one embodiment, the invention relates to a double-stranded RNA (dsRNA) agent for inhibiting the expression of a target gene. The dsRNA agent comprises a sense strand and an antisense strand, each strand having 14 to 40 nucleotides:

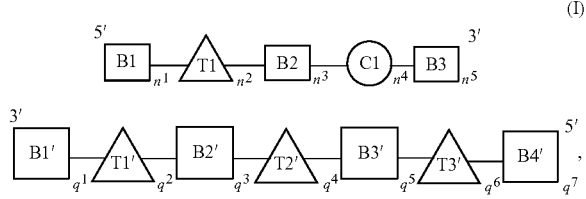

wherein:

B1, B2, B3, B1', B2', B3', and B4' each independently represent a nucleotide containing a modification selected from the group consisting of 2'-Oalkyl, 2'-substituted alkoxy, 2'-substituted alkyl, 2'-halo, ENA, and BNA/LNA;

C1 is an acyclic nucleotide (e.g., UNA or GNA);

T1, T1', T2', and T3' each independently represent a nucleotide comprising a chemical modification selected from the group consisting of DNA, RNA, LNA, 2'-F, and 2'-F-5'-methyl;

$n^1$, $n^3$, or $q^1$ is independently 4 to 15 nucleotides in length;

$n^5$, $q^3$ or $q^7$ is independently 1-6 nucleotide(s) in length;

$n^4$, $q^2$ or $q^6$ is independently 1-3 nucleotide(s) in length; alternatively $n^4$ is 0, $n^2$ or $q^4$ is independently 0-3 nucleotide(s) in length;

$q^5$ is independently 0-10 nucleotide(s) in length; and wherein the dsRNA agent has a 3' overhang of 2 nucleotides in length at the 3'-end of the antisense.

In one embodiment, the invention relates to a double-stranded RNA (dsRNA) agent for inhibiting the expression of a target gene. The dsRNA agent comprises a sense strand and an antisense strand, each strand having 15-30 nucleotides:

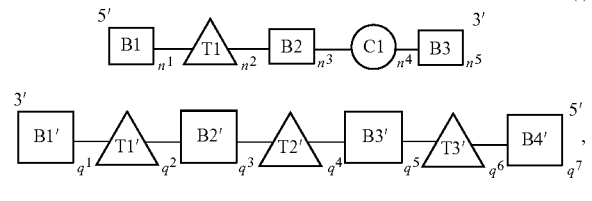

wherein:

B1, B2, B3, B1', B2', B3', and B4' each independently represent a nucleotide containing a modification 2'-OMe;

C1 is an acyclic nucleotide GNA;

T1, T1', T2', and T3' each are independently DNA or RNA;

$n^1$, $n^3$, or $q^1$ is independently 4 to 15 nucleotides in length;

$n^5$, $q^3$ or $q^7$ is independently 1-6 nucleotide(s) in length;

$n^4$, $q^2$ or $q^6$ is independently 1-3 nucleotide(s) in length; alternatively $n^4$ is 0, $n^2$ or $q^4$ is independently 0-3 nucleotide(s) in length;

$q^5$ is independently 0-10 nucleotide(s) in length; and wherein the dsRNA agent has a 3' overhang of 1-6 nucleotides in length at the 3'-end of the antisense.

In one embodiment, the invention relates to a double-stranded RNA (dsRNA) agent for inhibiting the expression of a target gene. The dsRNA agent comprises a sense strand and an antisense strand, each strand having 19-23 nucleotides:

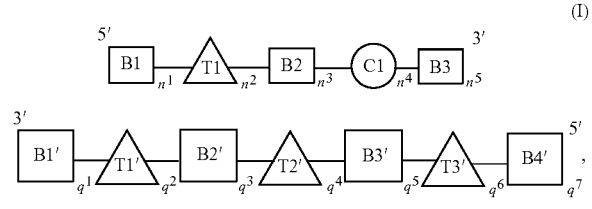

wherein:

B1, B2, B3, B1', B2', B3', and B4' each independently represent a nucleotide containing a 2'-OMe modification;

C1 is an acyclic nucleotide GNA;

T1, T1', T2', and T3' are independently DNA or RNA;

$n^1$, $n^3$, q', or $q^3$ is independently 4 to 15 nucleotides in length;

$n^5$, $q^3$ or $q^7$ is independently 1-6 nucleotide(s) in length;

$n^4$, $q^2$ or $q^6$ is independently 1-3 nucleotide(s) in length; alternatively $n^4$ is 0, $n^2$, $q^4$ or $q^5$ is independently 0-3 nucleotide(s) in length;

$q^5$ is independently 0-10 nucleotide(s) in length; and wherein the dsRNA agent has a 3' overhang of 2 nucleotides in length at the 3'-end of the antisense.

In one embodiment, the invention relates to a double-stranded RNA (dsRNA) agent for inhibiting the expression of a target gene. The dsRNA agent comprises a sense strand and an antisense strand, each strand having 14 to 40 nucleotides:

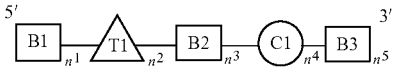

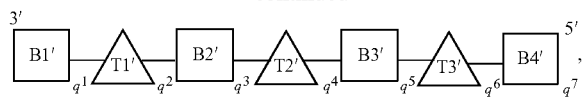

wherein:

B1, B2, B3, B1', B2', B3', and B4' each independently represent a nucleotide containing a modification selected from the group consisting of 2'-Oalkyl, 2'-substituted alkoxy, 2'-substituted alkyl, 2'-halo, ENA, and BNA/LNA;

C1 is an acyclic nucleotide (e.g., UNA or GNA);

T1, T1', T2', and T3' each independently represent a nucleotide comprising a chemical modification selected from the group consisting of DNA, RNA, LNA, 2'-F, and 2'-F-5'-methyl;

$n^1$, $n^3$, or $q^1$ is independently 4 to 15 nucleotides in length;

$n^5$, $q^3$ or $q^7$ is independently 1-6 nucleotide(s) in length;

$n^4$, $q^2$ or $q^6$ is independently 1-3 nucleotide(s) in length; alternatively $n^4$ is 0, $n^2$ or $q^4$ is independently 0-3 nucleotide(s) in length;

$q^5$ is independently 0-10 nucleotide(s) in length; and wherein the dsRNA agent has a 5' overhang of 1-10 nucleotides in length at the 5'-end of the sense.

In one embodiment, the invention relates to a double-stranded RNA (dsRNA) agent for inhibiting the expression of a target gene. The dsRNA agent comprises a sense strand and an antisense strand, each strand having 14 to 40 nucleotides:

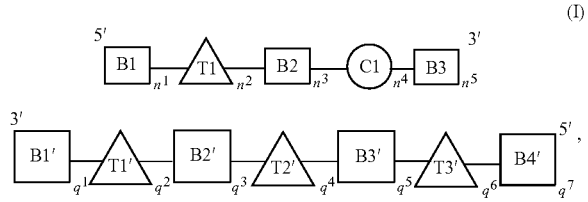

wherein:

B1, B2, B3, B1', B2', B3', and B4' each independently represent a nucleotide containing a modification selected from the group consisting of 2'-Oalkyl, 2'-substituted alkoxy, 2'-substituted alkyl, 2'-halo, ENA, and BNA/LNA;

C1 is an acyclic nucleotide (e.g., UNA or GNA);

T1, T1', T2', and T3' each independently represent a nucleotide comprising a chemical modification selected from the group consisting of DNA, RNA, LNA, 2'-F, and 2'-F-5'-methyl;

$n^1$, $n^3$, or $q^1$ is independently 4 to 15 nucleotides in length;

$n^5$, $q^3$ or $q^7$ is independently 1-6 nucleotide(s) in length;

$n^4$, $q^2$ or $q^6$ is independently 1-3 nucleotide(s) in length; alternatively $n^4$ is 0, $n^2$ or $q^4$ is independently 0-3 nucleotide(s) in length;

$q^5$ is independently 0-10 nucleotide(s) in length; and wherein the dsRNA agent has a 5' overhang of 1-6 nucleotides in length at the 5'-end of the sense.

In one embodiment, the invention relates to a double-stranded RNA (dsRNA) agent for inhibiting the expression of a target gene. The dsRNA agent comprises a sense strand and an antisense strand, each strand having 14 to 40 nucleotides:

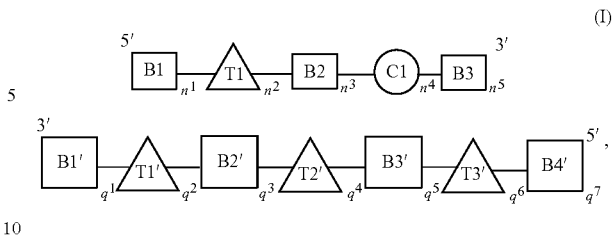

wherein:

B1, B2, B3, B1', B2', B3', and B4' each independently represent a nucleotide containing a modification selected from the group consisting of 2'-Oalkyl, 2'-substituted alkoxy, 2'-substituted alkyl, 2'-halo, ENA, and BNA/LNA;

C1 is an acyclic nucleotide (e.g., UNA or GNA);

T1, T1', T2', and T3' each independently represent a nucleotide comprising a chemical modification selected from the group consisting of DNA, RNA, LNA, 2'-F, and 2'-F-5'-methyl;

$n^1$, $n^3$, or $q^1$ is independently 4 to 15 nucleotides in length;

$n^5$, $q^3$ or $q^7$ is independently 1-6 nucleotide(s) in length;

$n^4$, $q^2$ or $q^6$ is independently 1-3 nucleotide(s) in length; alternatively $n^4$ is 0, $n^2$ or $q^4$ is independently 0-3 nucleotide(s) in length;

$q^5$ is independently 0-10 nucleotide(s) in length; and wherein the dsRNA agent has a 5' overhang of 1-10 nucleotides in length at the 5'-end of the sense and a 3' overhang of 1-10 nucleotides in length at the 5'-end of the antisense strand.

Thermally Destabilizing Modifications

The dsRNA agent can be optimized for RNA interference by increasing the propensity of the dsRNA duplex to disassociate or melt (decreasing the free energy of duplex association) by introducing a thermally destabilizing modification in the sense strand at a site opposite to the seed region of the antisense strand (i.e., at positions 2-8 of the 5'-end of the antisense strand). This modification can increase the propensity of the duplex to disassociate or melt in the seed region of the antisense strand.

The thermally destabilizing modifications can include abasic modification; mismatch with the opposing nucleotide in the opposing strand; and sugar modification such as 2'-deoxy modification or acyclic nucleotide, e.g., unlocked nucleic acids (UNA) or glycerol nucleic acid (GNA).

Exemplified abasic modifications are:

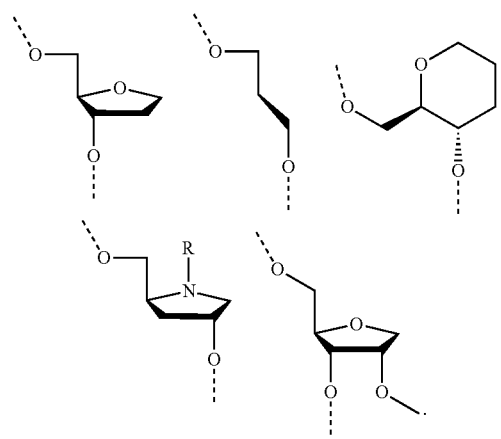

Exemplified sugar modifications are:

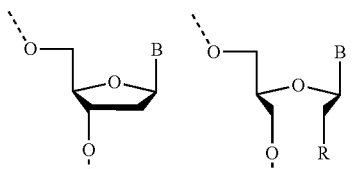

2'-deoxy unlocked nucleic acid
R = H, OH, O-alkyl

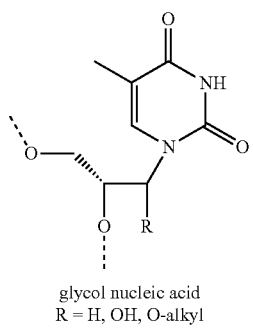

glycol nucleic acid
R = H, OH, O-alkyl

The term "acyclic nucleotide" refers to any nucleotide having an acyclic ribose sugar, for example, where any of bonds between the ribose carbons (e.g., C1'—C2', C2'—C3', C3'—C4', C4'-)4', or C1'-O4') is absent and/or at least one of ribose carbons or oxygen (e.g., C1', C2', C3', C4' or O4') are independently or in combination absent from the nucleotide. In some embodiments, acyclic nucleotide is

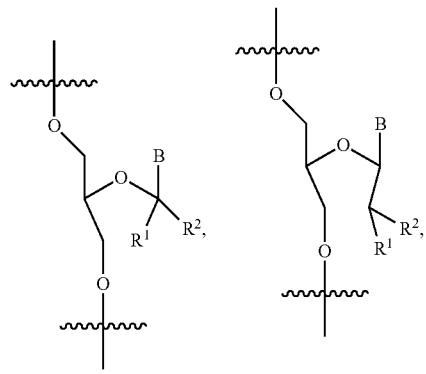

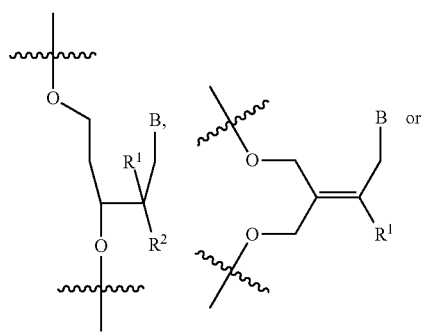

-continued

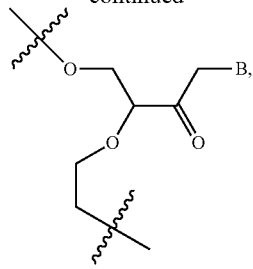

wherein B is a modified or unmodified nucleobase, $R^1$ and $R^2$ independently are H, halogen, $OR_3$, or alkyl; and $R_3$ is H, alkyl, cycloalkyl, aryl, aralkyl, heteroaryl or sugar). The term "UNA" refers to unlocked acyclic nucleic acid, wherein any of the bonds of the sugar has been removed, forming an unlocked "sugar" residue. In one example, UNA also encompasses monomers with bonds between C 1'—C4' being removed (i.e. the covalent carbon-oxygen-carbon bond between the C1' and C4' carbons). In another example, the C2'—C3' bond (i.e. the covalent carbon-carbon bond between the CT and C3' carbons) of the sugar is removed (see Mikhailov et. al., Tetrahedron Letters, 26 (17): 2059 (1985); and Fluiter et al., Mol. Biosyst., 10: 1039 (2009), which are hereby incorporated by reference in their entirety). The acyclic derivative provides greater backbone flexibility without affecting the Watson-Crick pairings. The acyclic nucleotide can be linked via 2'-5' or 3'-5' linkage.

The term 'GNA' refers to glycol nucleic acid which is a polymer similar to DNA or RNA but differing in the composition of its "backbone" in that is composed of repeating glycerol units linked by phosphodiester bonds:

The thermally destabilizing modification can be mismatches (i.e., noncomplementary base pairs) between the thermally destabilizing nucleotide and the opposing nucleotide in the opposite strand within the dsRNA duplex. Exemplary mismatch base pairs include G:G, G:A, G:U, G:T, A:A, A:C, C:C, C:U, C:T, U:U, T:T, U:T, or a combination thereof. Other mismatch base pairings known in the art are also amenable to the present invention. A mismatch can occur between nucleotides that are either naturally occurring nucleotides or modified nucleotides, i.e., the mismatch base pairing can occur between the nucleobases from respective nucleotides independent of the modifications on the ribose sugars of the nucleotides. In certain embodiments, the dsRNA agent contains at least one nucleobase in the mismatch pairing that is a 2'-deoxy nucleobase; e.g., the 2'-deoxy nucleobase is in the sense strand.

More examples of abasic nucleotide, acyclic nucleotide modifications (including UNA and GNA), and mismatch modifications have been described in detail in WO 2011/133876, which is herein incorporated by reference in its entirety.

The thermally destabilizing modifications may also include universal base with reduced or abolished capability to form hydrogen bonds with the opposing bases, and phosphate modifications.

Nucleobase modifications with impaired or completely abolished capability to form hydrogen bonds with bases in the opposite strand have been evaluated for destabilization of the central region of the dsRNA duplex as described in WO 2010/0011895, which is herein incorporated by reference in its entirety. Exemplary nucleobase modifications are:

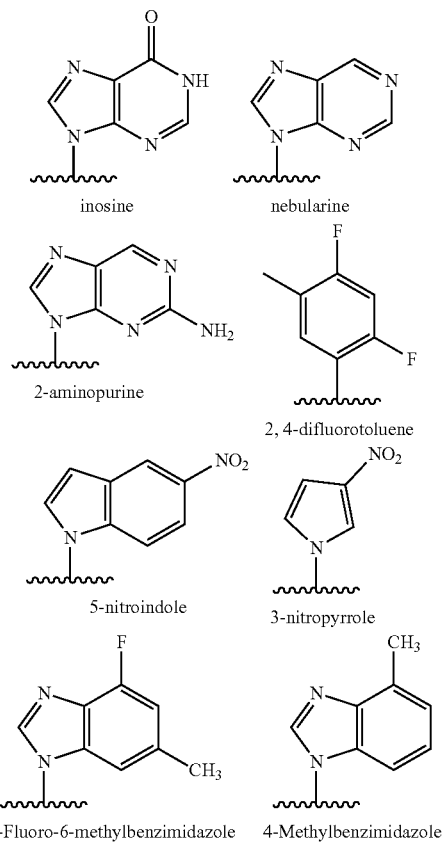

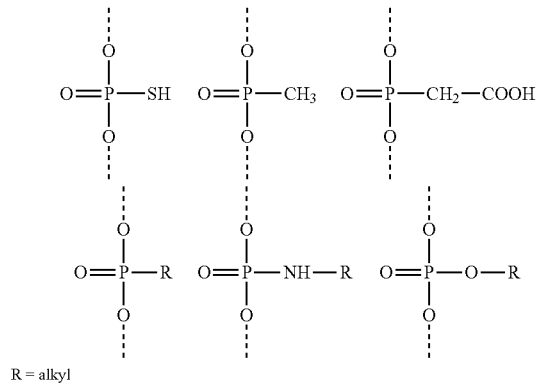

R = alkyl

Exemplary phosphate modifications known to decrease the thermal stability of dsRNA duplexes compared to natural phosphodiester linkages are:

In one embodiment, the dsRNA agent of the invention can comprise 2'-5' linkages (with 2'-H, 2'-OH and 2'-OMe and with P=O or P=S). For example, the 2'-5' linkages modifications can be used to promote nuclease resistance or to inhibit binding of the sense to the antisense strand, or can be used at the 5' end of the sense strand to avoid sense strand activation by RISC.

In another embodiment, the dsRNA agent of the invention can comprise L sugars (e.g., L ribose, L-arabinose with 2'-H, 2'-OH and 2'-OMe). For example, these L sugars modifications can be used to promote nuclease resistance or to inhibit binding of the sense to the antisense strand, or can be used at the 5' end of the sense strand to avoid sense strand activation by RISC.

In one embodiment, the dsRNA agent is a multimer containing at least two duplexes represented by formula (I), wherein said duplexes are connected by a linker. The linker can be cleavable or non-cleavable. Optionally, said multimer further comprise a ligand. Each of the dsRNA agent can target the same gene or two different genes; or each of the dsRNA agent can target same gene at two different target sites.

In one embodiment, the dsRNA agent is a multimer containing three, four, five, six or more duplexes represented by formula (I), wherein said duplexes are connected by a linker. The linker can be cleavable or non-cleavable. Optionally, said multimer further comprises a ligand. Each of the dsRNA agent can target the same gene or two different genes; or each of the dsRNA agent can target same gene at two different target sites.

In one embodiment, two dsRNA agent represented by formula (I) are linked to each other at the 5' end, and one or both of the 3' ends of the are optionally conjugated to a ligand. Each of the dsRNA can target the same gene or two different genes; or each of the dsRNA can target same gene at two different target sites.

Various publications described multimeric siRNA and can all be used with the dsRNA of the invention. Such publications include WO2007/091269, U.S. Pat. No. 7,858,769, WO2010/141511, WO2007/117686, WO2009/014887 and WO2011/031520 which are hereby incorporated by their entirely.

The dsRNA agent that contains conjugations of one or more carbohydrate moieties to a dsRNA agent can optimize one or more properties of the dsRNA agent. In many cases, the carbohydrate moiety will be attached to a modified subunit of the dsRNA agent. E.g., the ribose sugar of one or more ribonucleotide subunits of a dsRNA agent can be replaced with another moiety, e.g., a non-carbohydrate (preferably cyclic) carrier to which is attached a carbohydrate ligand. A ribonucleotide subunit in which the ribose sugar of the subunit has been so replaced is referred to herein as a ribose replacement modification subunit (RRMS). A cyclic carrier may be a carbocyclic ring system, i.e., all ring atoms are carbon atoms, or a heterocyclic ring system, i.e., one or more ring atoms may be a heteroatom, e.g., nitrogen, oxygen, sulfur. The cyclic carrier may be a monocyclic ring system, or may contain two or more rings, e.g. fused rings. The cyclic carrier may be a fully saturated ring system, or it may contain one or more double bonds.

The ligand may be attached to the polynucleotide via a carrier. The carriers include (i) at least one "backbone attachment point," preferably two "backbone attachment points" and (ii) at least one "tethering attachment point." A "backbone attachment point" as used herein refers to a functional group, e.g. a hydroxyl group, or generally, a bond available for, and that is suitable for incorporation of the carrier into the backbone, e.g., the phosphate, or modified phosphate, e.g., sulfur containing, backbone, of a ribonucleic acid. A "tethering attachment point" (TAP) in some embodiments refers to a constituent ring atom of the cyclic carrier, e.g., a carbon atom or a heteroatom (distinct from an atom which provides a backbone attachment point), that connects a selected moiety. The moiety can be, e.g., a carbohydrate, e.g. monosaccharide, disaccharide, trisaccharide, tetrasaccharide, oligosaccharide and polysaccharide. Optionally, the selected moiety is connected by an intervening tether to the cyclic carrier. Thus, the cyclic carrier will often include a functional group, e.g., an amino group, or generally, provide a bond, that is suitable for incorporation or tethering of another chemical entity, e.g., a ligand to the constituent ring.

In one embodiment the dsRNA agent of the invention is conjugated to a ligand via a carrier, wherein the carrier can be cyclic group or acyclic group; preferably, the cyclic group is selected from pyrrolidinyl, pyrazolinyl, pyrazolidinyl, imidazolinyl, imidazolidinyl, piperidinyl, piperazinyl, [1,3] dioxolane, oxazolidinyl, isoxazolidinyl, morpholinyl, thiazolidinyl, isothiazolidinyl, quinoxalinyl, pyridazinonyl, tetrahydrofuryl and and decalin; preferably, the acyclic group is selected from serinol backbone or diethanolamine backbone.

The double-stranded RNA (dsRNA) agent of the invention may optionally be conjugated to one or more ligands. The ligand can be attached to the sense strand, antisense strand or both strands, at the 3'-end, 5'-end or both ends. For instance, the ligand may be conjugated to the sense strand, in particular, the 3'-end of the sense strand.

In one embodiment dsRNA agents of the invention are 5' phosphorylated or include a phosphoryl analog at the 5' prime terminus. 5'-phosphate modifications include those which are compatible with RISC mediated gene silencing. Suitable modifications include: 5'-monophosphate ((HO)$_2$(O)P—O-5'); 5'-diphosphate ((HO)$_2$(O)P—O—P(HO)(O)—O-5'); 5'-triphosphate ((HO)$_2$(O)P—O—(HO)(O)P—O—P(HO)(O)—O-5'); 5'-guanosine cap (7-methylated or non-methylated) (7m-G-O-5'-(HO)(O)P—O—(HO)(O)P—O—P(HO)(O)—O-5'); 5'-adenosine cap (Appp), and any modified or unmodified nucleotide cap structure (N—O-5'-(HO)(O)P—O—(HO)(O)P—O—P(HO)(O)—O-5'); 5'-monothiophosphate (phosphorothioate; (HO)$_2$(S)P—O-5'); 5'-monodithiophosphate (phosphorodithioate; (HO)(HS)(S)P—O-5'), 5'-phosphorothiolate ((HO)$_2$(O)P—S-5'); any additional combination of oxygen/sulfur replaced monophosphate, diphosphate and triphosphates (e.g. 5'-alpha-thiotriphosphate, 5'-gamma-thiotriphosphate, etc.), 5'-phosphoramidates ((HO)$_2$(O)P—NH-5', (HO)(NH$_2$)(O)P—O-5'), 5'-alkylphosphonates (R=alkyl=methyl, ethyl, isopropyl, propyl, etc., e.g. RP(OH)(O)—O-5'-, 5'-alkenylphosphonates (i.e. vinyl, substituted vinyl), (OH)$_2$(O)P-5'—CH$_2$-), 5'-alkyletherphosphonates (R=alkylether=methoxymethyl (MeOCH$_2$-), ethoxymethyl, etc., e.g. RP(OH)(O)—O-5'-). In one example, the modification can in placed in the antisense strand of a dsRNA agent.

Lijands

A wide variety of entities can be coupled to the oligonucleotides of the present invention. Preferred moieties are ligands, which are coupled, preferably covalently, either directly or indirectly via an intervening tether.

In preferred embodiments, a ligand alters the distribution, targeting or lifetime of the molecule into which it is incorporated. In preferred embodiments a ligand provides an enhanced affinity for a selected target, e.g., molecule, cell or cell type, compartment, receptor e.g., a cellular or organ compartment, tissue, organ or region of the body, as, e.g., compared to a species absent such a ligand. Ligands providing enhanced affinity for a selected target are also termed targeting ligands.

Some ligands can have endosomolytic properties. The endosomolytic ligands promote the lysis of the endosome and/or transport of the composition of the invention, or its components, from the endosome to the cytoplasm of the cell. The endosomolytic ligand may be a polyanionic peptide or peptidomimetic which shows pH-dependent membrane activity and fusogenicity. In one embodiment, the endosomolytic ligand assumes its active conformation at endosomal pH. The "active" conformation is that conformation in which the endosomolytic ligand promotes lysis of the endosome and/or transport of the composition of the invention, or its components, from the endosome to the cytoplasm of the cell. Exemplary endosomolytic ligands include the GALA peptide (Subbarao et al., Biochemistry, 1987, 26: 2964-2972, which is incorporated by reference in its entirety), the EALA peptide (Vogel et al., J. Am. Chem. Soc., 1996, 118: 1581-1586, which is incorporated by reference in its entirety), and their derivatives (Turk et al., Biochem. Biophys. Acta, 2002, 1559: 56-68, which is incorporated by reference in its entirety). In one embodiment, the endosomolytic component may contain a chemical group (e.g., an amino acid) which will undergo a change in charge or protonation in response to a change in pH. The endosomolytic component may be linear or branched.

Ligands can improve transport, hybridization, and specificity properties and may also improve nuclease resistance of the resultant natural or modified oligoribonucleotide, or a polymeric molecule comprising any combination of monomers described herein and/or natural or modified ribonucleotides.

Ligands in general can include therapeutic modifiers, e.g., for enhancing uptake; diagnostic compounds or reporter groups e.g., for monitoring distribution; cross-linking agents; and nuclease-resistance conferring moieties. General examples include lipids, steroids, vitamins, sugars, proteins, peptides, polyamines, and peptide mimics.

Ligands can include a naturally occurring substance, such as a protein (e.g., human serum albumin (HSA), low-density lipoprotein (LDL), high-density lipoprotein (HDL), or globulin); a carbohydrate (e.g., a dextran, pullulan, chitin, chitosan, inulin, cyclodextrin or hyaluronic acid); or a lipid. The ligand may also be a recombinant or synthetic molecule, such as a synthetic polymer, e.g., a synthetic polyamino acid, an oligonucleotide (e.g. an aptamer). Examples of polyamino acids include polyamino acid is a polylysine (PLL), poly L-aspartic acid, poly L-glutamic acid, styrene-maleic acid anhydride copolymer, poly(L-lactide-co-glycolide) copolymer, divinyl ether-maleic anhydride copolymer, N-(2-hydroxypropyl)methacrylamide copolymer (HMPA), polyethylene glycol (PEG), polyvinyl alcohol (PVA), polyurethane, poly(2-ethylacryllic acid), N-isopropylacrylamide polymers, or polyphosphazine. Example of polyamines include: polyethylenimine, polylysine (PLL), spermine, spermidine, polyamine, pseudopeptide-polyamine, peptidomimetic polyamine, dendrimer polyamine, arginine, amidine, protamine, cationic lipid, cationic porphyrin, quaternary salt of a polyamine, or an alpha helical peptide.

Ligands can also include targeting groups, e.g., a cell or tissue targeting agent, e.g., a lectin, glycoprotein, lipid or protein, e.g., an antibody, that binds to a specified cell type such as a kidney cell. A targeting group can be a thyrotropin, melanotropin, lectin, glycoprotein, surfactant protein A, Mucin carbohydrate, multivalent lactose, multivalent galactose, N-acetyl-galactosamine, N-acetyl-glucosamine multivalent mannose, multivalent fucose, glycosylated polyamino acids, multivalent galactose, transferrin, bisphosphonate, polyglutamate, polyaspartate, a lipid, cholesterol, a steroid, bile acid, folate, vitamin B12, biotin, an RGD peptide, an RGD peptide mimetic or an aptamer. Table 2 shows some examples of targeting ligands and their associated receptors.

Other examples of ligands include dyes, intercalating agents (e.g. acridines), cross-linkers (e.g. psoralen, mitomycin C), porphyrins (TPPC4, texaphyrin, Sapphyrin), poly-cyclic aromatic hydrocarbons (e.g., phenazine, dihydrophenazine), artificial endonucleases or a chelator (e.g. EDTA), lipophilic molecules, e.g., cholesterol, cholic acid, adamantane acetic acid, 1-pyrene butyric acid, dihydrotestosterone, 1,3-Bis-O(hexadecyl)glycerol, geranyloxyhexyl group, hexadecylglycerol, borneol, menthol, 1,3-propanediol, heptadecyl group, palmitic acid, myristic acid,03-(oleoyl)lithocholic acid, 03-(oleoyl)cholenic acid, dimethoxytrityl, or phenoxazine) and peptide conjugates (e.g., antennapedia peptide, Tat peptide), alkylating agents, phosphate, amino, mercapto, PEG (e.g., PEG-40K), MPEG, [MPEG]$_2$, polyamino, alkyl, substituted alkyl, radiolabeled markers, enzymes, haptens (e.g. biotin), transport/absorption facilitators (e.g., aspirin, vitamin E, folic acid), synthetic ribonucleases (e.g., imidazole, bisimidazole, histamine, imidazole clusters, acridine-imidazole conjugates, Eu3+complexes of tetraazamacrocycles), dinitrophenyl, HRP, or AP.

Ligands can be proteins, e.g., glycoproteins, or peptides, e.g., molecules having a specific affinity for a co-ligand, or antibodies e.g., an antibody, that binds to a specified cell type such as a cancer cell, endothelial cell, or bone cell. Ligands may also include hormones and hormone receptors. They can also include non-peptidic species, such as lipids, lectins, carbohydrates, vitamins, cofactors, multivalent lactose, multivalent galactose, N-acetyl-galactosamine, N-acetyl-glucosamine multivalent mannose, multivalent fucose, or aptamers. The ligand can be, for example, a lipopolysaccharide, an activator of p38 MAP kinase, or an activator of NF-κB.

The ligand can be a substance, e.g., a drug, which can increase the uptake of the iRNA agent into the cell, for example, by disrupting the cell's cytoskeleton, e.g., by disrupting the cell's microtubules, microfilaments, and/or intermediate filaments. The drug can be, for example, taxon, vincristine, vinblastine, cytochalasin, nocodazole, japlakinolide, latrunculin A, phalloidin, swinholide A, indanocine, or myoservin.

The ligand can increase the uptake of the oligonucleotide into the cell by activating an inflammatory response, for example. Exemplary ligands that would have such an effect include tumor necrosis factor alpha (TNF-alpha), interleukin-1 beta, or gamma interferon.

In one aspect, the ligand is a lipid or lipid-based molecule. Such a lipid or lipid-based molecule preferably binds a serum protein, e.g., human serum albumin (HSA). An HSA binding ligand allows for distribution of the conjugate to a target tissue, e.g., a non-kidney target tissue of the body. For example, the target tissue can be the liver, including parenchymal cells of the liver. Other molecules that can bind HSA can also be used as ligands. For example, naproxen or aspirin can be used. A lipid or lipid-based ligand can (a) increase resistance to degradation of the conjugate, (b) increase targeting or transport into a target cell or cell membrane, and/or (c) can be used to adjust binding to a serum protein, e.g., HSA.

A lipid based ligand can be used to modulate, e.g., control the binding of the conjugate to a target tissue. For example, a lipid or lipid-based ligand that binds to HSA more strongly will be less likely to be targeted to the kidney and therefore less likely to be cleared from the body. A lipid or lipid-based ligand that binds to HSA less strongly can be used to target the conjugate to the kidney.

In a preferred embodiment, the lipid based ligand binds HSA. Preferably, it binds HSA with a sufficient affinity such that the conjugate will be preferably distributed to a non-kidney tissue. However, it is preferred that the affinity not be so strong that the HSA-ligand binding cannot be reversed.

In another preferred embodiment, the lipid based ligand binds HSA weakly or not at all, such that the conjugate will be preferably distributed to the kidney. Other moieties that target to kidney cells can also be used in place of or in addition to the lipid based ligand.

In another aspect, the ligand is a moiety, e.g., a vitamin, which is taken up by a target cell, e.g., a proliferating cell. These are particularly useful for treating disorders characterized by unwanted cell proliferation, e.g., of the malignant or non-malignant type, e.g., cancer cells. Exemplary vitamins include vitamin A, E, and K. Other exemplary vitamins include B vitamins, e.g., folic acid, B12, riboflavin, biotin, pyridoxal or other vitamins or nutrients taken up by cancer cells. Also included are HAS, low density lipoprotein (LDL) and high-density lipoprotein (HDL).

In another aspect, the ligand is a cell-permeation agent, preferably a helical cell-permeation agent. Preferably, the agent is amphipathic. An exemplary agent is a peptide such as tat or antennapedia. If the agent is a peptide, it can be modified, including a peptidylmimetic, invertomers, non-peptide or pseudo-peptide linkages, and use of D-amino acids. The helical agent is preferably an alpha-helical agent, which preferably has a lipophilic and a lipophobic phase.

The ligand can be a peptide or peptidomimetic. A peptidomimetic (also referred to herein as an oligopeptidomimetic) is a molecule capable of folding into a defined three-dimensional structure similar to a natural peptide. The peptide or peptidomimetic moiety can be about 5-50 amino acids long, e.g., about 5, 10, 15, 20, 25, 30, 35, 40, 45, or 50 amino acids long. A peptide or peptidomimetic can be, for example, a cell permeation peptide, cationic peptide, amphipathic peptide, or hydrophobic peptide (e.g., consisting primarily of Tyr, Trp or Phe). The peptide moiety can be a dendrimer peptide, constrained peptide or crosslinked peptide. In another alternative, the peptide moiety can include a hydrophobic membrane translocation sequence (MTS). An exemplary hydrophobic MTS-containing peptide is RFGF having the amino acid sequence AAVALLPAVL-LALLAP (SEQ ID NO: 1). An RFGF analogue (e.g., amino acid sequence AALLPVLLAAP (SEQ ID NO: 2)) containing a hydrophobic MTS can also be a targeting moiety. The peptide moiety can be a "delivery" peptide, which can carry large polar molecules including peptides, oligonucleotides, and protein across cell membranes. For example, sequences from the HIV Tat protein (GRKKRRQRRRPPQ (SEQ ID NO: 3)) and the Drosophila Antennapedia protein (RQIKIWFQNRRMKWKK (SEQ ID NO: 4)) have been found to be capable of functioning as delivery peptides. A peptide or peptidomimetic can be encoded by a random sequence of DNA, such as a peptide identified from a phage-display library, or one-bead-one-compound (OBOC) combinatorial library (Lam et al., Nature, 354:82-84, 1991, which is incorporated by reference in its entirety). Preferably the peptide or peptidomimetic tethered to an iRNA agent via an incorporated monomer unit is a cell targeting peptide such as an arginine-glycine-aspartic acid (RGD)-peptide, or RGD mimic. A peptide moiety can range in length from about 5 amino acids to about 40 amino acids. The peptide moieties can have a structural modification, such as to increase stability or direct conformational properties. Any of the structural modifications described below can be utilized. An RGD peptide moiety can be used to target a tumor cell, such as an endothelial tumor cell or a breast cancer tumor cell (Zitzmann et al., Cancer Res., 62:5139-43, 2002, which is incorporated by reference in its entirety). An RGD peptide can facilitate targeting of an iRNA agent to tumors of a variety of other tissues, including the lung, kidney, spleen, or liver (Aoki et al., Cancer Gene Therapy 8:783-787, 2001, which is incorporated by reference in its entirety). Preferably, the RGD peptide will facilitate targeting of an iRNA agent to the kidney. The RGD peptide can be linear or cyclic, and can be modified, e.g., glycosylated or methylated to facilitate targeting to specific tissues. For example, a glycosylated RGD peptide can deliver an iRNA agent to a tumor cell expressing $\alpha v \beta_3$ (Haubner et al., Jour. Nucl. Med., 42:326-336, 2001, which is incorporated by reference in its entirety). Peptides that target markers enriched in proliferating cells can be used. E.g., RGD containing peptides and peptidomimetics can target cancer cells, in particular cells that exhibit an integrin. Thus, one could use RGD peptides, cyclic peptides containing RGD, RGD peptides that include D-amino acids, as well as synthetic RGD mimics. In addition to RGD, one can use other moieties that target the integrin ligand. Generally, such ligands can be used to control proliferating cells and angiogenesis. Preferred conjugates of this type ligands that targets PECAM-1, VEGF, or other cancer gene, e.g., a cancer gene described herein.

A "cell permeation peptide" is capable of permeating a cell, e.g., a microbial cell, such as a bacterial or fungal cell, or a mammalian cell, such as a human cell. A microbial cell-permeating peptide can be, for example, an a-helical linear peptide (e.g., LL-37 or Ceropin P1), a disulfide bond-containing peptide (e.g., α-defensin, β-defensin or bactenecin), or a peptide containing only one or two dominating amino acids (e.g., PR-39 or indolicidin). A cell permeation peptide can also include a nuclear localization signal (NLS). For example, a cell permeation peptide can be a bipartite amphipathic peptide, such as MPG, which is derived from the fusion peptide domain of HIV-1 gp41 and the NLS of SV40 large T antigen (Simeoni et al., Nucl. Acids Res. 31:2717-2724, 2003, which is incorporated by reference in its entirety).

In one embodiment, a targeting peptide can be an amphipathic a-helical peptide. Exemplary amphipathic a-helical peptides include, but are not limited to, cecropins, lycotoxins, paradaxins, buforin, CPF, bombinin-like peptide (BLP), cathelicidins, ceratotoxins, S. clava peptides, hagfish intestinal antimicrobial peptides (HFIAPs), magainines, brevinins-2, dermaseptins, melittins, pleurocidin, $H_2A$ peptides, Xenopus peptides, esculentinis-1, and caerins. A number of factors will preferably be considered to maintain the integrity of helix stability. For example, a maximum number of helix stabilization residues will be utilized (e.g., leu, ala, or lys), and a minimum number helix destabilization residues will be utilized (e.g., proline, or cyclic monomeric units. The capping residue will be considered (for example Gly is an exemplary N-capping residue and/or C-terminal amidation can be used to provide an extra H-bond to stabilize the helix. Formation of salt bridges between residues with opposite charges, separated by i±3, or i±4 positions can provide stability. For example, cationic residues such as lysine, arginine, homo-arginine, ornithine or histidine can form salt bridges with the anionic residues glutamate or aspartate.

Peptide and peptidomimetic ligands include those having naturally occurring or modified peptides, e.g., D or L peptides; α, β, or γ peptides; N-methyl peptides; azapeptides; peptides having one or more amide, i.e., peptide, linkages replaced with one or more urea, thiourea, carbamate, or sulfonyl urea linkages; or cyclic peptides.

The targeting ligand can be any ligand that is capable of targeting a specific receptor. Examples are: folate, GalNAc, galactose, mannose, mannose-6P, clusters of sugars such as GalNAc cluster, mannose cluster, galactose cluster, or an aptamer. A cluster is a combination of two or more sugar units. The targeting ligands also include integrin receptor ligands, Chemokine receptor ligands, transferrin, biotin, serotonin receptor ligands, PSMA, endothelin, GCPII, somatostatin, LDL and HDL ligands. The ligands can also be based on nucleic acid, e.g., an aptamer. The aptamer can be unmodified or have any combination of modifications disclosed herein.

Endosomal release agents include imidazoles, poly or oligoimidazoles, PEIs, peptides, fusogenic peptides, polycarboxylates, polycations, masked oligo or poly cations or anions, acetals, polyacetals, ketals/polyketals, orthoesters, polymers with masked or unmasked cationic or anionic charges, dendrimers with masked or unmasked cationic or anionic charges.

PK modulator stands for pharmacokinetic modulator. PK modulator include lipophiles, bile acids, steroids, phospholipid analogues, peptides, protein binding agents, PEG, vitamins etc. Exemplary PK modulator include, but are not limited to, cholesterol, fatty acids, cholic acid, lithocholic acid, dialkylglycerides, diacylglyceride, phospholipids, sphingolipids, naproxen, ibuprofen, vitamin E, biotin etc. Oligonucleotides that comprise a number of phosphorothioate linkages are also known to bind to serum protein, thus short oligonucleotides, e.g. oligonucleotides of about 5 bases, 10 bases, 15 bases or 20 bases, comprising multiple of phosphorothioate linkages in the backbone are also amenable to the present invention as ligands (e.g. as PK modulating ligands).

In addition, aptamers that bind serum components (e.g. serum proteins) are also amenable to the present invention as PK modulating ligands.

Other ligand conjugates amenable to the invention are described in U.S. Patent Applications USSN: 10/916,185, filed Aug. 10, 2004; USSN: 10/946,873, filed Sep. 21, 2004; USSN: 10/833,934, filed Aug. 3, 2007; USSN: 11/115,989 filed Apr. 27, 2005 and USSN: 11/944,227 filed Nov. 21, 2007, which are incorporated by reference in their entireties for all purposes.

When two or more ligands are present, the ligands can all have same properties, all have different properties or some ligands have the same properties while others have different properties. For example, a ligand can have targeting properties, have endosomolytic activity or have PK modulating properties. In a preferred embodiment, all the ligands have different properties.

Ligands can be coupled to the oligonucleotides at various places, for example, 3'-end, 5'-end, and/or at an internal position. In preferred embodiments, the ligand is attached to the oligonucleotides via an intervening tether, e.g. a carrier described herein. The ligand or tethered ligand may be present on a monomer when said monomer is incorporated into the growing strand. In some embodiments, the ligand may be incorporated via coupling to a "precursor" monomer after said "precursor" monomer has been incorporated into the growing strand. For example, a monomer having, e.g., an amino-terminated tether (i.e., having no associated ligand), e.g., TAP-$(CH_2)_n NH_2$ may be incorporated into a growing oligonucleotide strand. In a subsequent operation, i.e., after incorporation of the precursor monomer into the strand, a ligand having an electrophilic group, e.g., a pentafluorophenyl ester or aldehyde group, can subsequently be attached to the precursor monomer by coupling the electrophilic group of the ligand with the terminal nucleophilic group of the precursor monomer's tether.

In another example, a monomer having a chemical group suitable for taking part in Click Chemistry reaction may be incorporated e.g., an azide or alkyne terminated tether/linker. In a subsequent operation, i.e., after incorporation of the precursor monomer into the strand, a ligand having complementary chemical group, e.g. an alkyne or azide can be attached to the precursor monomer by coupling the alkyne and the azide together.

For double-stranded oligonucleotides, ligands can be attached to one or both strands. In some embodiments, a double-stranded iRNA agent contains a ligand conjugated to the sense strand. In other embodiments, a double-stranded iRNA agent contains a ligand conjugated to the antisense strand.

In some embodiments, ligand can be conjugated to nucleobases, sugar moieties, or internucleosidic linkages of nucleic acid molecules. Conjugation to purine nucleobases or derivatives thereof can occur at any position including, endocyclic and exocyclic atoms. In some embodiments, the 2-, 6-, 7-, or 8-positions of a purine nucleobase are attached to a conjugate moiety. Conjugation to pyrimidine nucleobases or derivatives thereof can also occur at any position. In some embodiments, the 2-, 5-, and 6-positions of a pyrimidine nucleobase can be substituted with a conjugate moiety. Conjugation to sugar moieties of nucleosides can occur at any carbon atom. Example carbon atoms of a sugar moiety that can be attached to a conjugate moiety include the 2', 3', and 5' carbon atoms. The 1' position can also be attached to a conjugate moiety, such as in an abasic residue. Internucleosidic linkages can also bear conjugate moieties. For phosphorus-containing linkages (e.g., phosphodiester, phosphorothioate, phosphorodithioate, phosphoroamidate, and the like), the conjugate moiety can be attached directly to the phosphorus atom or to an O, N, or S atom bound to the phosphorus atom. For amine- or amide-containing internucleosidic linkages (e.g., PNA), the conjugate moiety can be attached to the nitrogen atom of the amine or amide or to an adjacent carbon atom.

Any suitable ligand in the field of RNA interference may be used, although the ligand is typically a carbohydrate e.g. monosaccharide (such as GalNAc), disaccharide, trisaccharide, tetrasaccharide, polysaccharide.

Linkers that conjugate the ligand to the nucleic acid include those discussed above. For example, the ligand can be one or more GalNAc (N-acetylglucosamine) derivatives attached through a monovalent, bivalent or trivalent branched linker.

In one embodiment, the dsRNA of the invention is conjugated to a bivalent and trivalent branched linkers include the structures shown in any of formula (IV)—(VII):

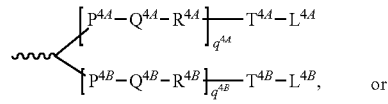

Formula (IV)

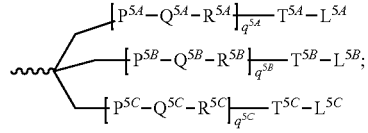

Formula (V)

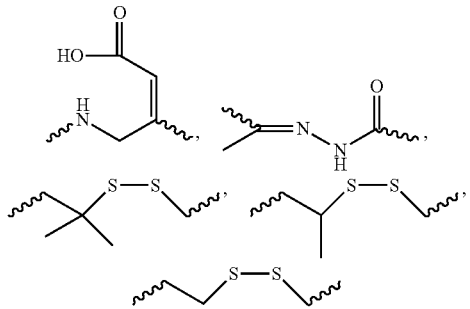

Formula (VI)

Formula (VII)

wherein:

$q^{2A}$, $q^{2B}$, $q^{3A}$, $q^{3B}$, $q^{4A}$, $q^{4B}$, $q^{5A}$, $q^{5B}$ and $q^{5C}$ represent independently for each occurrence 0-20 and wherein the repeating unit can be the same or different;

$P^{2A}$, $P^{2B}$, $P^{3A}$, $P^{3B}$, $P^{4A}$, $P^{4B}$, $P^{5A}$, $P^{5B}$, $P^{5C}$, $T^{2A}$, $T^{2B}$, $T^{3A}$, $T^{3B}$, $T^{4A}$, $T^{4B}$, $T^{5A}$, $T^{5B}$, $T^{5C}$ are each independently for each occurrence absent, CO, NH, O, S, OC(O), NHC(O), CH$_2$, CH$_2$NH or CH$_2$O;

$Q^{2A}$, $Q^{2B}$, $Q^{3A}$, $Q^{3B}$, $Q^{4A}$, $Q^{4B}$, $Q^{5A}$, $Q^{5B}$, $Q^{5C}$ are independently for each occurrence absent, alkylene, substituted alkylene wherein one or more methylenes can be interrupted or terminated by one or more of O, S, S(O), SO$_2$, N(R$^N$), C(R')=C(R''), C≡C or C(O);

$R^{2A}$, $R^{2B}$, $R^{3A}$, $R^{3B}$, $R^{4A}$, $R^{4B}$, $R^{5A}$, $R^{5B}$, $R^{5C}$ are each independently for each occurrence absent, NH, O, S, CH$_2$, C(O)O, C(O)NH, NHCH(R$^a$)C(O), —C(O)—CH(R$^a$)—NH—, CO, CH=N—O,

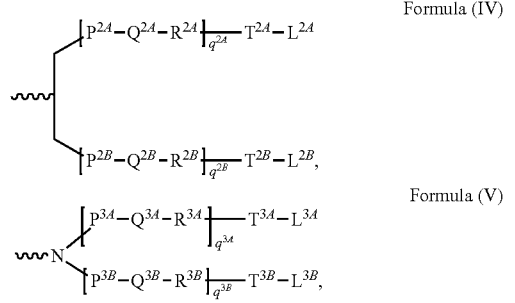

or heterocyclyl;

$L^{2A}$, $L^{2B}$, $L^{3A}$, $L^{3B}$, $L^{4A}$, $L^{4B}$, $L^{5A}$, $L^{5B}$ and $L^{5C}$ represent the ligand; i.e. each independently for each occurrence a monosaccharide (such as GalNAc), disaccharide, trisaccharide, tetrasaccharide, oligosaccharide, or polysaccharide; and R$^a$ is H or amino acid side chain.

Trivalent conjugating GalNAc derivatives are particularly useful for use with RNAi agents for inhibiting the expression of a target gene, such as those of formula (VII):

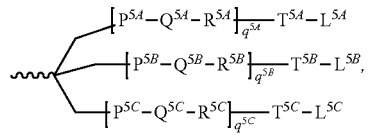

Formula (VII)

wherein $L^{5A}$, $L^{5B}$ and $L^{5C}$ represent a monosaccharide, such as GalNAc derivative.

Examples of suitable bivalent and trivalent branched linker groups conjugating GalNAc derivatives include, but are not limited to, the following compounds:
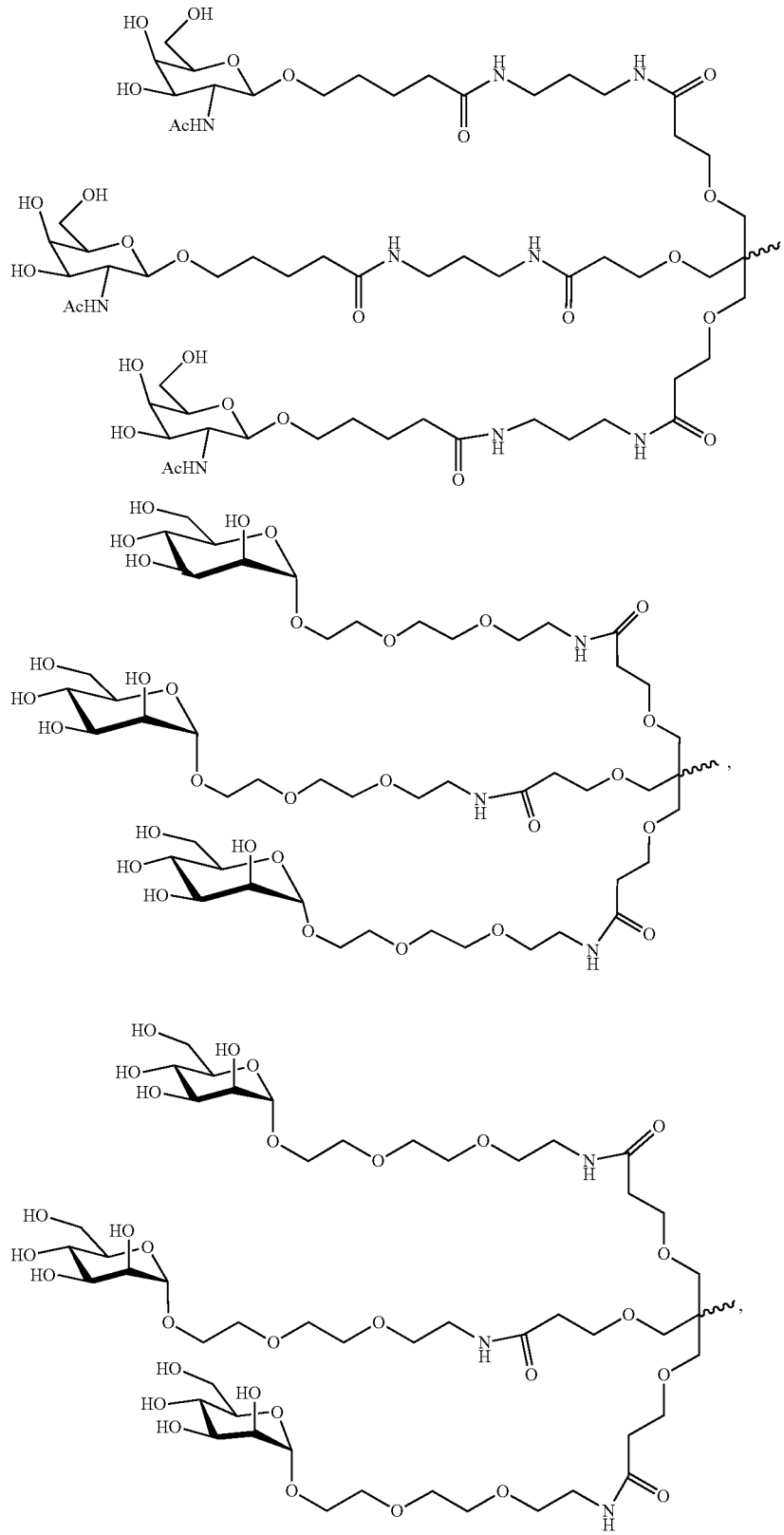

-continued
61
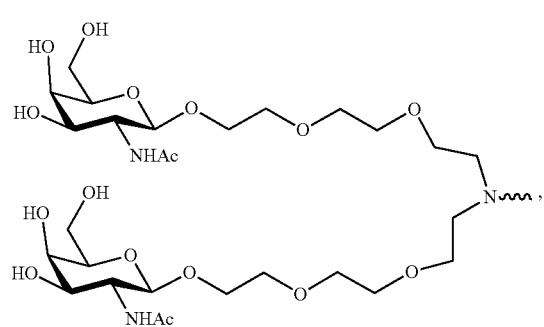
62
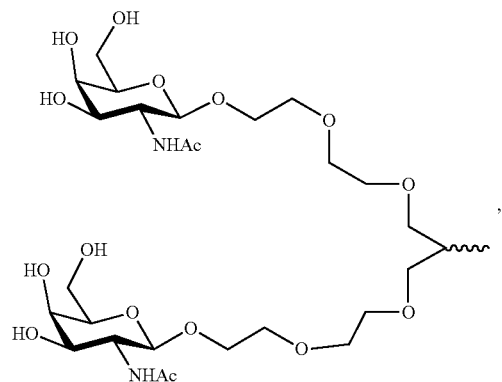
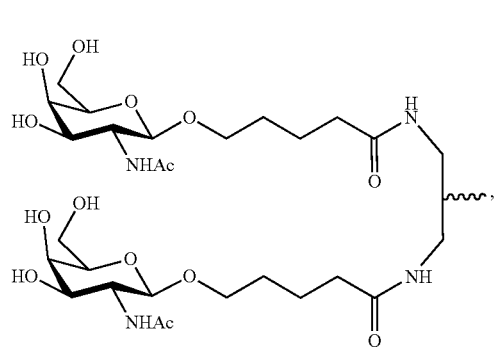
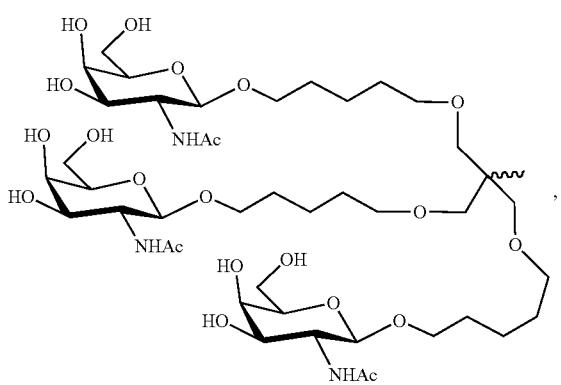
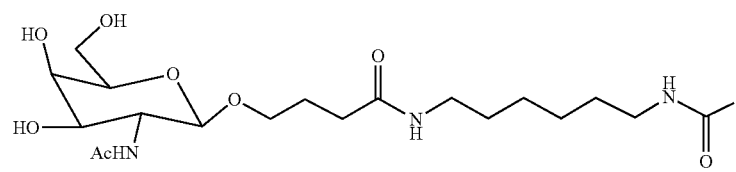
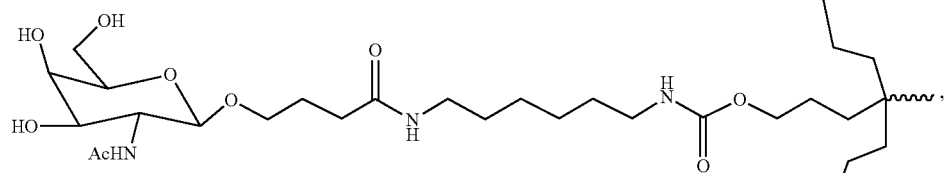
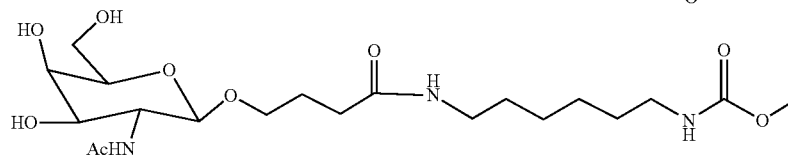

-continued

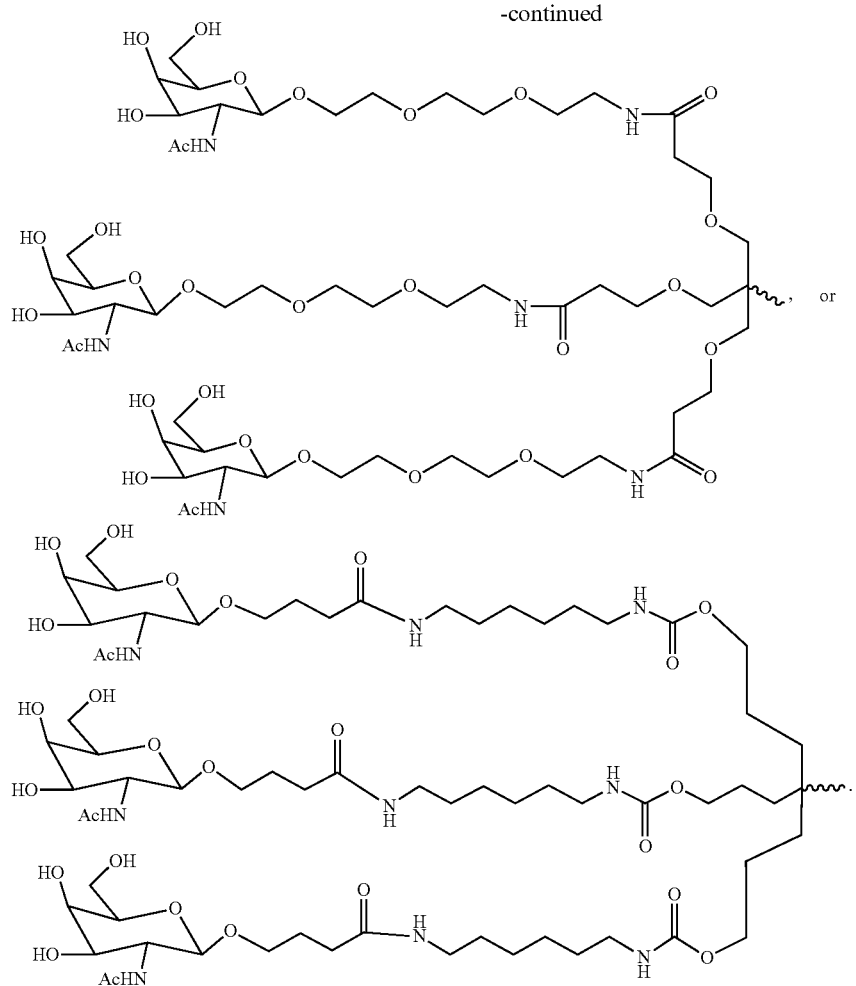

Definitions

As used herein, the terms "dsRNA", "siRNA", and "iRNA agent" are used interchangeably to agents that can mediate silencing of a target RNA, e.g., mRNA, e.g., a transcript of a gene that encodes a protein. For convenience, such mRNA is also referred to herein as mRNA to be silenced. Such a gene is also referred to as a target gene. In general, the RNA to be silenced is an endogenous gene or a pathogen gene. In addition, RNAs other than mRNA, e.g., tRNAs, and viral RNAs, can also be targeted.

As used herein, the phrase "mediates RNAi" refers to the ability to silence, in a sequence specific manner, a target RNA. While not wishing to be bound by theory, it is believed that silencing uses the RNAi machinery or process and a guide RNA, e.g., an siRNA agent of 21 to 23 nucleotides.

As used herein, "specifically hybridizable" and "complementary" are terms which are used to indicate a sufficient degree of complementarity such that stable and specific binding occurs between a compound of the invention and a target RNA molecule. Specific binding requires a sufficient degree of complementarity to avoid non-specific binding of the oligomeric compound to non-target sequences under conditions in which specific binding is desired, i.e., under physiological conditions in the case of assays or therapeutic treatment, or in the case of in vitro assays, under conditions in which the assays are performed. The non-target sequences typically differ by at least 5 nucleotides.

In one embodiment, a dsRNA agent of the invention is "sufficiently complementary" to a target RNA, e.g., a target mRNA, such that the dsRNA agent silences production of protein encoded by the target mRNA. In another embodiment, the dsRNA agent of the invention is "exactly complementary" to a target RNA, e.g., the target RNA and the dsRNA duplex agent anneal, for example to form a hybrid made exclusively of Watson-Crick base pairs in the region of exact complementarity. A "sufficiently complementary" target RNA can include an internal region (e.g., of at least 10 nucleotides) that is exactly complementary to a target RNA. Moreover, in some embodiments, the dsRNA agent of the invention specifically discriminates a single-nucleotide difference. In this case, the dsRNA agent only mediates RNAi if exact complementary is found in the region (e.g., within 7 nucleotides of) the single-nucleotide difference.

As used herein, the term "oligonucleotide" refers to a nucleic acid molecule (RNA or DNA) for example of length less than 100, 200, 300, or 400 nucleotides.

The term 'BNA' refers to bridged nucleic acid, and is often referred as constrained or inaccessible RNA. BNA can contain a 5-, 6-membered, or even a 7-membered bridged structure with a "fixed" C3'-endo sugar puckering. The bridge is typically incorporated at the 2'-, 4'-position of the ribose to afford a 2', 4'-BNA nucleotide (e.g., LNA, or ENA). Examples of BNA nucleotides include the following nucleosides:

The term 'LNA' refers to locked nucleic acid, and is often referred as constrained or inaccessible RNA. LNA is a modified RNA nucleotide. The ribose moiety of an LNA nucleotide is modified with an extra bridge (e.g., a methylene bridge or an ethylene bridge) connecting the 2' hydroxyl to the 4' carbon of the same ribose sugar. For instance, the bridge can "lock" the ribose in the 3'-endo North) conformation:

The term 'ENA' refers to ethylene-bridged nucleic acid, and is often referred as constrained or inaccessible RNA.

The "cleavage site" herein means the backbone linkage in the target gene or the sense strand that is cleaved by the RISC mechanism by utilizing the iRNA agent. And the target cleavage site region comprises at least one or at least two nucleotides on both side of the cleavage site. For the sense strand, the cleavage site is the backbone linkage in the sense strand that would get cleaved if the sense strand itself was the target to be cleaved by the RNAi mechanism. The cleavage site can be determined using methods known in the art, for example the 5'-RACE assay as detailed in Soutschek et al., *Nature* (2004) 432, 173-178, which is incorporated by reference in its entirety. As is well understood in the art, the cleavage site region for a conical double stranded RNAi agent comprising two 21-nucleotides long strands (wherein the strands form a double stranded region of 19 consecutive base pairs having 2-nucleotide single stranded overhangs at the 3'-ends), the cleavage site region corresponds to positions 9-12 from the 5'-end of the sense strand.

The term "halo" refers to any radical of fluorine, chlorine, bromine or iodine. The term "alkyl" refers to saturated and unsaturated non-aromatic hydrocarbon chains that may be a straight chain or branched chain, containing the indicated number of carbon atoms (these include without limitation propyl, allyl, or propargyl), which may be optionally inserted with N, O, or S. For example, $C_1$—$C_{10}$ indicates that the group may have from 1 to 10 (inclusive) carbon atoms in it. The term "alkoxy" refers to an —O-alkyl radical. The term "alkylene" refers to a divalent alkyl (i.e., -R-). The term "alkylenedioxo" refers to a divalent species of the structure —O—R—O—, in which R represents an alkylene. The term "aminoalkyl" refers to an alkyl substituted with an amino. The term "mercapto" refers to an —SH radical. The term "thioalkoxy" refers to an —S— alkyl radical.

The term "aryl" refers to a 6-carbon monocyclic or 10-carbon bicyclic aromatic ring system wherein 0, 1, 2, 3, or 4 atoms of each ring may be substituted by a substituent. Examples of aryl groups include phenyl, naphthyl and the like. The term "arylalkyl" or the term "aralkyl" refers to alkyl substituted with an aryl. The term "arylalkoxy" refers to an alkoxy substituted with aryl.

The term "cycloalkyl" as employed herein includes saturated and partially unsaturated cyclic hydrocarbon groups having 3 to 12 carbons, for example, 3 to 8 carbons, and, for example, 3 to 6 carbons, wherein the cycloalkyl group additionally may be optionally substituted. Cycloalkyl groups include, without limitation, cyclopropyl, cyclobutyl, cyclopentyl, cyclopentenyl, cyclohexyl, cyclohexenyl, cycloheptyl, and cyclooctyl.

The term "heteroaryl" refers to an aromatic 5-8 membered monocyclic, 8-12 membered bicyclic, or 11-14 membered tricyclic ring system having 1-3 heteroatoms if monocyclic, 1-6 heteroatoms if bicyclic, or 1-9 heteroatoms if tricyclic, said heteroatoms selected from O, N, or S (e.g., carbon atoms and 1-3, 1-6, or 1-9 heteroatoms of N, O, or S if monocyclic, bicyclic, or tricyclic, respectively), wherein 0, 1, 2, 3, or 4 atoms of each ring may be substituted by a substituent. Examples of heteroaryl groups include pyridyl, furyl or furanyl, imidazolyl, benzimidazolyl, pyrimidinyl, thiophenyl or thienyl, quinolinyl, indolyl, thiazolyl, and the like. The term "heteroarylalkyl" or the term "heteroaralkyl" refers to an alkyl substituted with a heteroaryl. The term "heteroarylalkoxy" refers to an alkoxy substituted with heteroaryl.

The term "heterocyclyl" refers to a nonaromatic 5-8 membered monocyclic, 8-12 membered bicyclic, or 11-14 membered tricyclic ring system having 1-3 heteroatoms if monocyclic, 1-6 heteroatoms if bicyclic, or 1-9 heteroatoms if tricyclic, said heteroatoms selected from O, N, or S (e.g., carbon atoms and 1-3, 1-6, or 1-9 heteroatoms of N, O, or S if monocyclic, bicyclic, or tricyclic, respectively), wherein 0, 1, 2 or 3 atoms of each ring may be substituted by a substituent. Examples of heterocyclyl groups include trizolyl, tetrazolyl, piperazinyl, pyrrolidinyl, dioxanyl, morpholinyl, tetrahydrofuranyl, and the like.

The term "oxo" refers to an oxygen atom, which forms a carbonyl when attached to carbon, an N-oxide when attached to nitrogen, and a sulfoxide or sulfone when attached to sulfur.

The term "acyl" refers to an alkylcarbonyl, cycloalkylcarbonyl, arylcarbonyl, heterocyclylcarbonyl, or heteroarylcarbonyl substituent, any of which may be further substituted by substituents.

The term "substituted" refers to the replacement of one or more hydrogen radicals in a given structure with the radical of a specified substituent including, but not limited to: halo, alkyl, alkenyl, alkynyl, aryl, heterocyclyl, thiol, alkylthio, arylthio, alkylthioalkyl, arylthioalkyl, alkylsulfonyl, alkylsulfonylalkyl, arylsulfonylalkyl, alkoxy, aryloxy, aralkoxy, aminocarbonyl, alkylaminocarbonyl, arylaminocarbonyl, alkoxycarbonyl, aryloxycarbonyl, haloalkyl, amino, trifluoromethyl, cyano, nitro, alkylamino, arylamino, alkylaminoalkyl, arylaminoalkyl, aminoalkylamino, hydroxy, alkoxyalkyl, carboxyalkyl, alkoxycarbonylalkyl, aminocarbonylalkyl, acyl, aralkoxycarbonyl, carboxylic acid, sulfonic acid, sulfonyl, phosphonic acid, aryl, heteroaryl, heterocyclic, and aliphatic. It is understood that the sub stituent can be further substituted.

Cleavable Linking Groups

A cleavable linking group is one which is sufficiently stable outside the cell, but which upon entry into a target cell is cleaved to release the two parts the linker is holding together. In a preferred embodiment of the dsRNA agent according to the present invention, the cleavable linking group is cleaved at least 10 times or more, preferably at least 100 times faster in the target cell or under a first reference condition (which can, e.g., be selected to mimic or represent intracellular conditions) than in the blood of a subject, or under a second reference condition (which can, e.g., be selected to mimic or represent conditions found in the blood or serum).

Cleavable linking groups are susceptible to cleavage agents, e.g., pH, redox potential or the presence of degradative molecules. Generally, cleavage agents are more prevalent or found at higher levels or activities inside cells than in serum or blood. Examples of such degradative agents include: redox agents which are selected for particular substrates or which have no substrate specificity, including, e.g., oxidative or reductive enzymes or reductive agents such as mercaptans, present in cells, that can degrade a redox cleavable linking group by reduction; esterases; endosomes or agents that can create an acidic environment, e.g., those that result in a pH of five or lower; enzymes that can hydrolyze or degrade an acid cleavable linking group by acting as a general acid, peptidases (which can be substrate specific), and phosphatases.

A cleavable linkage group, such as a disulfide bond can be susceptible to pH. The pH of human serum is 7.4, while the average intracellular pH is slightly lower, ranging from about 7.1-7.3. Endosomes have a more acidic pH, in the range of 5.5-6.0, and lysosomes have an even more acidic pH at around 5.0. Some linkers will have a cleavable linking group that is cleaved at a preferred pH, thereby releasing the cationic lipid from the ligand inside the cell, or into the desired compartment of the cell.

A linker can include a cleavable linking group that is cleavable by a particular enzyme. The type of cleavable linking group incorporated into a linker can depend on the cell to be targeted. For example, liver targeting ligands can be linked to the cationic lipids through a linker that includes an ester group. Liver cells are rich in esterases, and therefore the linker will be cleaved more efficiently in liver cells than in cell types that are not esterase-rich. Other cell-types rich in esterases include cells of the lung, renal cortex, and testis.

Linkers that contain peptide bonds can be used when targeting cell types rich in peptidases, such as liver cells and synoviocytes.

In general, the suitability of a candidate cleavable linking group can be evaluated by testing the ability of a degradative agent (or condition) to cleave the candidate linking group. It will also be desirable to also test the candidate cleavable linking group for the ability to resist cleavage in the blood or when in contact with other non-target tissue. Thus one can determine the relative susceptibility to cleavage between a first and a second condition, where the first is selected to be indicative of cleavage in a target cell and the second is selected to be indicative of cleavage in other tissues or biological fluids, e.g., blood or serum. The evaluations can be carried out in cell free systems, in cells, in cell culture, in organ or tissue culture, or in whole animals. It may be useful to make initial evaluations in cell-free or culture conditions and to confirm by further evaluations in whole animals. In preferred embodiments, useful candidate compounds are cleaved at least 2, 4, 10 or 100 times faster in the cell (or under in vitro conditions selected to mimic intracellular conditions) as compared to blood or serum (or under in vitro conditions selected to mimic extracellular conditions).

Redox Cleavable Linking Groups

One class of cleavable linking groups is redox cleavable linking groups, which may be used in the dsRNA agent according to the present invention. that are cleaved upon reduction or oxidation. An example of reductively cleavable linking group is a disulphide linking group (—S—S—). To determine if a candidate cleavable linking group is a suitable "reductively cleavable linking group," or for example is suitable for use with a particular iRNA moiety and particular targeting agent one can look to methods described herein. For example, a candidate can be evaluated by incubation with dithiothreitol (DTT), or other reducing agent using reagents know in the art, which mimic the rate of cleavage which would be observed in a cell, e.g., a target cell. The candidates can also be evaluated under conditions which are selected to mimic blood or serum conditions. In a preferred embodiment, candidate compounds are cleaved by at most 10% in the blood. In preferred embodiments, useful candidate compounds are degraded at least 2, 4, 10 or 100 times faster in the cell (or under in vitro conditions selected to mimic intracellular conditions) as compared to blood (or under in vitro conditions selected to mimic extracellular conditions). The rate of cleavage of candidate compounds can be determined using standard enzyme kinetics assays under conditions chosen to mimic intracellular media and compared to conditions chosen to mimic extracellular media.

Phosphate-Based Cleavable Linking Groups Phosphate-based cleavable linking groups, which may be used in the dsRNA agent according to the present invention, are cleaved by agents that degrade or hydrolyze the phosphate group. An example of an agent that cleaves phosphate groups in cells are enzymes such as phosphatases in cells. Examples of phosphate-based linking groups are —O—P(O)(ORk)-O—, P(S)(ORk)-O—, —O—P(S)(SRk)-O—, —S—P(O)(ORk)-O—, —O—P(O)(ORk)-S—, —S—P(O)(ORk)-S—, P(S)(ORk)-S—, —S—P(S)(ORk)-O—, —O—P(O)(Rk)-O—, —O—P(S)(Rk)-O—, —S—P(O)(Rk)-O—, —S—P(S)(Rk)-O—, —S—P(O)(Rk)-S—, —O—P(S)(Rk)-S—. Preferred embodiments are —O—P(O)(OH)—O—, —O—P(S)(OH)—O—, —O—P(S)(SH)—O—, —S—P(O)(OH)—O—, —O—P(O)(OH)—S—, —S—P(O)(OH)—S—, —O—P(S)(OH)—S—, —S—P(S)(OH)—O—, —O—P(O)(H)—O—, —O—P(S)(H)—O—, —S—P(O)(H)—O—, —S—P(S)(H)—O—, —S—P(O)(H)—S—, —O—P(S)(H)—S—. A preferred embodiment is —O—P(O)(OH)—O—. These candidates can be evaluated using methods analogous to those described above.

Acid Cleavable Linking Groups

Acid cleavable linking groups, which may be used in the dsRNA agent according to the present invention, are linking groups that are cleaved under acidic conditions. In preferred embodiments acid cleavable linking groups are cleaved in an acidic environment with a pH of about 6.5 or lower (e.g., about 6.0, 5.5, 5.0, or lower), or by agents such as enzymes that can act as a general acid. In a cell, specific low pH organelles, such as endosomes and lysosomes can provide a cleaving environment for acid cleavable linking groups. Examples of acid cleavable linking groups include but are not limited to hydrazones, esters, and esters of amino acids. Acid cleavable groups can have the general formula —C=NN—, C(O)O, or —OC(O). A preferred embodiment is when the carbon attached to the oxygen of the ester (the alkoxy group) is an aryl group, substituted alkyl group, or tertiary alkyl group such as dimethyl pentyl or t-butyl. These candidates can be evaluated using methods analogous to those described above.

Ester-Based Linking Groups

Ester-based cleavable linking groups, which may be used in the dsRNA agent according to the present invention, are cleaved by enzymes such as esterases and amidases in cells. Examples of ester-based cleavable linking groups include but are not limited to esters of alkylene, alkenylene and alkynylene groups. Ester cleavable linking groups have the general formula —C(O)O—, or —OC(O)—. These candidates can be evaluated using methods analogous to those described above.

Peptide-Based Cleaving Groups

Peptide-based cleavable linking groups, which may be used in the dsRNA agent according to the present invention, are cleaved by enzymes such as peptidases and proteases in cells. Peptide-based cleavable linking groups are peptide bonds formed between amino acids to yield oligopeptides (e.g., dipeptides, tripeptides etc.) and polypeptides. Peptide-based cleavable groups do not include the amide group (—C(O)NH—). The amide group can be formed between any alkylene, alkenylene or alkynlene. A peptide bond is a special type of amide bond formed between amino acids to yield peptides and proteins. The peptide based cleavage group is generally limited to the peptide bond (i.e., the amide bond) formed between amino acids yielding peptides and proteins and does not include the entire amide functional group. Peptide-based cleavable linking groups have the general formula—NHCHR$^A$C(O)NHCHR$^B$C(O)—, where R$^A$ and R$^B$ are the R groups of the two adjacent amino acids. These candidates can be evaluated using methods analogous to those described above. As used herein, "carbohydrate" refers to a compound which is either a carbohydrate per se made up of one or more monosaccharide units having at least 6 carbon atoms (which may be linear, branched or cyclic) with an oxygen, nitrogen or sulfur atom bonded to each carbon atom; or a compound having as a part thereof a carbohydrate moiety made up of one or more monosaccharide units each having at least six carbon atoms (which may be linear, branched or cyclic), with an oxygen, nitrogen or sulfur atom bonded to each carbon atom. Representative carbohydrates include the sugars (mono-, di-, tri- and oligosaccharides containing from about 4-9 monosaccharide units), and polysaccharides such as starches, glycogen, cellulose and polysaccharide gums. Specific monosaccharides include $C_5$ and above (preferably $C_5$-$C_8$) sugars; di- and trisaccharides include sugars having two or three monosaccharide units (preferably $C_5$-$C_8$).

The present invention further relates to a use of a dsRNA agent as defined herein for inhibiting expression of a target gene. In one embodiment, the present invention further relates to a use of a dsRNA agent for inhibiting expression of a target gene in vitro.

The present invention further relates to a dsRNA agent as defined herein for use in inhibiting expression of a target gene in a subject. The subject may be any animal, such as a mammal, e.g., a mouse, a rat, a sheep, a cattle, a dog, a cat, or a human.

In one embodiment, the dsRNA agent of the invention is administered in buffer.

In one embodiment, siRNA compounds described herein can be formulated for administration to a subject. A formulated siRNA composition can assume a variety of states. In some examples, the composition is at least partially crystalline, uniformly crystalline, and/or anhydrous (e.g., less than 80, 50, 30, 20, or 10% water). In another example, the siRNA is in an aqueous phase, e.g., in a solution that includes water.

The aqueous phase or the crystalline compositions can, e.g., be incorporated into a delivery vehicle, e.g., a liposome (particularly for the aqueous phase) or a particle (e.g., a microparticle as can be appropriate for a crystalline composition). Generally, the siRNA composition is formulated in a manner that is compatible with the intended method of administration, as described herein. For example, in particular embodiments the composition is prepared by at least one of the following methods: spray drying, lyophilization, vacuum drying, evaporation, fluid bed drying, or a combination of these techniques; or sonication with a lipid, freeze-drying, condensation and other self-assembly.

A siRNA preparation can be formulated in combination with another agent, e.g., another therapeutic agent or an agent that stabilizes a siRNA, e.g., a protein that complexes with siRNA to form an iRNP. Still other agents include chelators, e.g., EDTA (e.g., to remove divalent cations such as $Mg^{2+}$), salts, RNAse inhibitors (e.g., a broad specificity RNAse inhibitor such as RNAsin) and so forth.

In one embodiment, the siRNA preparation includes another siRNA compound, e.g., a second siRNA that can mediate RNAi with respect to a second gene, or with respect to the same gene. Still other preparation can include at least 3, 5, ten, twenty, fifty, or a hundred or more different siRNA species. Such siRNAs can mediate RNAi with respect to a similar number of different genes.

In one embodiment, the siRNA preparation includes at least a second therapeutic agent (e.g., an agent other than a RNA or a DNA). For example, a siRNA composition for the treatment of a viral disease, e.g., HIV, might include a known antiviral agent (e.g., a protease inhibitor or reverse transcriptase inhibitor). In another example, a siRNA composition for the treatment of a cancer might further comprise a chemotherapeutic agent.

Exemplary formulations which can be used for administering the dsRNA agent according to the present invention are discussed below.

Liposomes. For ease of exposition the formulations, compositions and methods in this section are discussed largely with regard to unmodified siRNA compounds. It may be understood, however, that these formulations, compositions and methods can be practiced with other siRNA compounds, e.g., modified siRNAs, and such practice is within the invention. An siRNA compound, e.g., a double-stranded siRNA compound, or ssiRNA compound, (e.g., a precursor, e.g., a larger siRNA compound which can be processed into a ssiRNA compound, or a DNA which encodes an siRNA compound, e.g., a double-stranded siRNA compound, or ssiRNA compound, or precursor thereof) preparation can be formulated for delivery in a membranous molecular assembly, e.g., a liposome or a micelle. As used herein, the term "liposome" refers to a vesicle composed of amphiphilic lipids arranged in at least one bilayer, e.g., one bilayer or a plurality of bilayers. Liposomes include unilamellar and multilamellar vesicles that have a membrane formed from a lipophilic material and an aqueous interior. The aqueous portion contains the siRNA composition. The lipophilic material isolates the aqueous interior from an aqueous exterior, which typically does not include the siRNA composition, although in some examples, it may. Liposomes are useful for the transfer and delivery of active ingredients to the site of action. Because the liposomal membrane is structurally similar to biological membranes, when liposomes are applied to a tissue, the liposomal bilayer fuses with bilayer of the cellular membranes. As the merging of the liposome and cell progresses, the internal aqueous contents that include the siRNA are delivered into the cell where the siRNA can specifically bind to a target RNA and can mediate RNAi. In some cases the liposomes are also specifically targeted, e.g., to direct the siRNA to particular cell types.

A liposome containing a siRNA can be prepared by a variety of methods. In one example, the lipid component of a liposome is dissolved in a detergent so that micelles are formed with the lipid component. For example, the lipid component can be an amphipathic cationic lipid or lipid conjugate. The detergent can have a high critical micelle concentration and may be nonionic. Exemplary detergents include cholate, CHAPS, octylglucoside, deoxycholate, and lauroyl sarcosine. The siRNA preparation is then added to the micelles that include the lipid component. The cationic groups on the lipid interact with the siRNA and condense around the siRNA to form a liposome. After condensation, the detergent is removed, e.g., by dialysis, to yield a liposomal preparation of siRNA.

If necessary a carrier compound that assists in condensation can be added during the condensation reaction, e.g., by controlled addition. For example, the carrier compound can be a polymer other than a nucleic acid (e.g., spermine or spermidine). pH can also be adjusted to favor condensation.

Further description of methods for producing stable polynucleotide delivery vehicles, which incorporate a polynucleotide/cationic lipid complex as structural components of the delivery vehicle, are described in, e.g., WO 96/37194. Liposome formation can also include one or more aspects of exemplary methods described in Felgner, P. L. et al., *Proc. Natl. Acad. Sci.*, USA 8:7413-7417, 1987; U.S. Pat. Nos. 4,897,355; 5,171,678; Bangham, et al. *M. Mol. Biol.* 23:238, 1965; Olson, et al. *Biochim. Biophys. Acta* 557:9, 1979; Szoka, et al. Proc. *Natl. Acad. Sci.* 75: 4194, 1978; Mayhew, et al. *Biochim. Biophys. Acta* 775:169, 1984; Kim, et al. *Biochim. Biophys. Acta* 728:339, 1983; and Fukunaga, et al. *Endocrinol.* 115:757, 1984, which are incorporated by reference in their entirety. Commonly used techniques for preparing lipid aggregates of appropriate size for use as delivery vehicles include sonication and freeze-thaw plus extrusion (see, e.g., Mayer, et al. *Biochim. Biophys. Acta* 858:161, 1986, which is incorporated by reference in its entirety). Microfluidization can be used when consistently small (50 to 200 nm) and relatively uniform aggregates are desired (Mayhew, et al. *Biochim. Biophys. Acta* 775:169, 1984, which is incorporated by reference in its entirety). These methods are readily adapted to packaging siRNA preparations into liposomes.

Liposomes that are pH-sensitive or negatively-charged entrap nucleic acid molecules rather than complex with them. Since both the nucleic acid molecules and the lipid are similarly charged, repulsion rather than complex formation occurs. Nevertheless, some nucleic acid molecules are entrapped within the aqueous interior of these liposomes. pH-sensitive liposomes have been used to deliver DNA encoding the thymidine kinase gene to cell monolayers in culture. Expression of the exogenous gene was detected in the target cells (Zhou et al., *Journal of Controlled Release*, 19, (1992) 269-274, which is incorporated by reference in its entirety).

One major type of liposomal composition includes phospholipids other than naturally-derived phosphatidylcholine. Neutral liposome compositions, for example, can be formed from dimyristoyl phosphatidylcholine (DMPC) or dipalmitoyl phosphatidylcholine (DPPC). Anionic liposome compositions generally are formed from dimyristoyl phosphatidylglycerol, while anionic fusogenic liposomes are formed primarily from dioleoyl phosphatidylethanolamine (DOPE). Another type of liposomal composition is formed from phosphatidylcholine (PC) such as, for example, soybean PC, and egg PC. Another type is formed from mixtures of phospholipid and/or phosphatidylcholine and/or cholesterol.

Examples of other methods to introduce liposomes into cells in vitro and include U.S. Pat. Nos. 5,283,185; 5,171, 678; WO 94/00569; WO 93/24640; WO 91/16024; Felgner, *J. Biol. Chem.* 269:2550, 1994; Nabel, *Proc. Natl. Acad. Sci.* 90:11307, 1993; Nabel, *Human Gene Ther.* 3:649, 1992; Gershon, *Biochem.* 32:7143, 1993; and Strauss *EMBO J.* 11:417, 1992.

In one embodiment, cationic liposomes are used. Cationic liposomes possess the advantage of being able to fuse to the cell membrane. Non-cationic liposomes, although not able to fuse as efficiently with the plasma membrane, are taken up by macrophages in vivo and can be used to deliver siRNAs to macrophages.

Further advantages of liposomes include: liposomes obtained from natural phospholipids are biocompatible and biodegradable; liposomes can incorporate a wide range of water and lipid soluble drugs; liposomes can protect encapsulated siRNAs in their internal compartments from metabolism and degradation (Rosoff, in "Pharmaceutical Dosage Forms," Lieberman, Rieger and Banker (Eds.), 1988, volume 1, p. 245). Important considerations in the preparation of liposome formulations are the lipid surface charge, vesicle size and the aqueous volume of the liposomes.

A positively charged synthetic cationic lipid, N-[1-(2,3-dioleyloxy)propyl]-N,N,N-trimethylammonium chloride (DOTMA) can be used to form small liposomes that interact spontaneously with nucleic acid to form lipid-nucleic acid complexes which are capable of fusing with the negatively charged lipids of the cell membranes of tissue culture cells, resulting in delivery of siRNA (see, e.g., Felgner, P. L. et al., Proc. Natl. Acad. Sci., USA 8:7413-7417, 1987 and U.S. Pat. No. 4,897,355 for a description of DOTMA and its use with DNA, which are incorporated by reference in their entirety).

A DOTMA analogue, 1,2-bis(oleoyloxy)-3-(trimethylammonia)propane (DOTAP) can be used in combination with a phospholipid to form DNA-complexing vesicles. Lipofectin™ Bethesda Research Laboratories, Gaithersburg, Md.) is an effective agent for the delivery of highly anionic nucleic acids into living tissue culture cells that comprise positively charged DOTMA liposomes which interact spontaneously with negatively charged polynucleotides to form complexes. When enough positively charged liposomes are used, the net charge on the resulting complexes is also positive. Positively charged complexes prepared in this way spontaneously attach to negatively charged cell surfaces, fuse with the plasma membrane, and efficiently deliver functional nucleic acids into, for example, tissue culture cells. Another commercially available cationic lipid, 1,2-bis(oleoyloxy)-3,3-(trimethylammonia)propane ("DOTAP") (Boehringer Mannheim, Indianapolis, Indiana) differs from DOTMA in that the oleoyl moieties are linked by ester, rather than ether linkages.

Other reported cationic lipid compounds include those that have been conjugated to a variety of moieties including, for example, carboxyspermine which has been conjugated to one of two types of lipids and includes compounds such as 5-carboxyspermylglycine dioctaoleoylamide ("DOGS") (Transfectam™, Promega, Madison, Wisconsin) and dipalmitoylphosphatidylethanolamine 5-carboxyspermylamide ("DPPES") (see, e.g., U.S. Pat. No. 5,171,678).

Another cationic lipid conjugate includes derivatization of the lipid with cholesterol ("DC-Chol") which has been formulated into liposomes in combination with DOPE (See, Gao, X. and Huang, L., Biochim. Biophys. Res. Commun. 179:280, 1991). Lipopolylysine, made by conjugating polylysine to DOPE, has been reported to be effective for transfection in the presence of serum (Zhou, X. et al., Biochim. Biophys. Acta 1065:8, 1991, which is incorporated by reference in its entirety). For certain cell lines, these liposomes containing conjugated cationic lipids, are said to exhibit lower toxicity and provide more efficient transfection than the DOTMA-containing compositions. Other commercially available cationic lipid products include DMRIE and DMRIE-HP (Vical, La Jolla, Calif.) and Lipofectamine (DOSPA) (Life Technology, Inc., Gaithersburg, Maryland). Other cationic lipids suitable for the delivery of oligonucleotides are described in WO 98/39359 and WO 96/37194.

Liposomal formulations are particularly suited for topical administration, liposomes present several advantages over other formulations. Such advantages include reduced side effects related to high systemic absorption of the administered drug, increased accumulation of the administered drug at the desired target, and the ability to administer siRNA, into the skin. In some implementations, liposomes are used for delivering siRNA to epidermal cells and also to enhance the penetration of siRNA into dermal tissues, e.g., into skin.

For example, the liposomes can be applied topically. Topical delivery of drugs formulated as liposomes to the skin has been documented (see, e.g., Weiner et al., *Journal of Drug Targeting,* 1992, vol. 2,405-410 and du Plessis et al., *Antiviral Research,* 18, 1992, 259-265; Mannino, R. J. and Fould-Fogerite, S., Biotechniques 6:682-690, 1988; Itani, T. et al. Gene 56:267-276. 1987; Nicolau, C. et al. Meth. Enz. 149:157-176, 1987; Straubinger, R. M. and Papahadjopoulos, D. Meth. Enz. 101:512-527, 1983; Wang, C. Y. and Huang, L., Proc. Natl. Acad. Sci. USA 84:7851-7855, 1987, which are incorporated by reference in their entirety).

Non-ionic liposomal systems have also been examined to determine their utility in the delivery of drugs to the skin, in particular systems comprising non-ionic surfactant and cholesterol. Non-ionic liposomal formulations comprising Novasome I (glyceryl dilaurate/cholesterol/polyoxyethylene-10-stearyl ether) and Novasome II (glyceryl distearate/cholesterol/polyoxyethylene-10-stearyl ether) were used to deliver a drug into the dermis of mouse skin. Such formulations with siRNA are useful for treating a dermatological disorder.

Liposomes that include siRNA can be made highly deformable. Such deformability can enable the liposomes to penetrate through pore that are smaller than the average radius of the liposome. For example, transfersomes are a type of deformable liposomes. Transfersomes can be made by adding surface edge activators, usually surfactants, to a standard liposomal composition. Transfersomes that include siRNA can be delivered, for example, subcutaneously by infection in order to deliver siRNA to keratinocytes in the skin. In order to cross intact mammalian skin, lipid vesicles must pass through a series of fine pores, each with a diameter less than 50 nm, under the influence of a suitable transdermal gradient. In addition, due to the lipid properties, these transfersomes can be self-optimizing (adaptive to the shape of pores, e.g., in the skin), self-repairing, and can frequently reach their targets without fragmenting, and often self-loading.

Other formulations amenable to the present invention are described in U.S. provisional application Ser. No. 61/018, 616, filed Jan. 2, 2008; 61/018,611, filed Jan. 2, 2008; 61/039,748, filed Mar. 26, 2008; 61/047,087, filed Apr. 22, 2008 and 61/051,528, filed May 8, 2008. PCT application no PCT/US2007/080331, filed Oct. 3, 2007 also describes formulations that are amenable to the present invention.

Surfactants. For ease of exposition the formulations, compositions and methods in this section are discussed largely with regard to unmodified siRNA compounds. It may be understood, however, that these formulations, compositions and methods can be practiced with other siRNA compounds, e.g., modified siRNA compounds, and such practice is within the scope of the invention. Surfactants find wide application in formulations such as emulsions (including microemulsions) and liposomes (see above). siRNA (or a precursor, e.g., a larger dsiRNA which can be processed into a siRNA, or a DNA which encodes a siRNA or precursor) compositions can include a surfactant. In one embodiment, the siRNA is formulated as an emulsion that includes a surfactant. The most common way of classifying and ranking the properties of the many different types of surfactants, both natural and synthetic, is by the use of the hydrophile/lipophile balance (HLB). The nature of the hydrophilic group provides the most useful means for categorizing the different surfactants used in formulations (Rieger, in "Pharmaceutical Dosage Forms," Marcel Dekker, Inc., New York, NY, 1988, p. 285).

If the surfactant molecule is not ionized, it is classified as a nonionic surfactant. Nonionic surfactants find wide application in pharmaceutical products and are usable over a wide range of pH values. In general their HLB values range from 2 to about 18 depending on their structure. Nonionic surfactants include nonionic esters such as ethylene glycol esters, propylene glycol esters, glyceryl esters, polyglyceryl esters, sorbitan esters, sucrose esters, and ethoxylated esters. Nonionic alkanolamides and ethers such as fatty alcohol ethoxylates, propoxylated alcohols, and ethoxylated/propoxylated block polymers are also included in this class. The polyoxyethylene surfactants are the most popular members of the nonionic surfactant class.

If the surfactant molecule carries a negative charge when it is dissolved or dispersed in water, the surfactant is classified as anionic. Anionic surfactants include carboxylates such as soaps, acyl lactylates, acyl amides of amino acids, esters of sulfuric acid such as alkyl sulfates and ethoxylated alkyl sulfates, sulfonates such as alkyl benzene sulfonates, acyl isethionates, acyl taurates and sulfosuccinates, and phosphates. The most important members of the anionic surfactant class are the alkyl sulfates and the soaps.

If the surfactant molecule carries a positive charge when it is dissolved or dispersed in water, the surfactant is classified as cationic. Cationic surfactants include quaternary ammonium salts and ethoxylated amines. The quaternary ammonium salts are the most used members of this class.

If the surfactant molecule has the ability to carry either a positive or negative charge, the surfactant is classified as amphoteric. Amphoteric surfactants include acrylic acid derivatives, substituted alkylamides, N-alkylbetaines and phosphatides.

The use of surfactants in drug products, formulations and in emulsions has been reviewed (Rieger, in "Pharmaceutical Dosage Forms," Marcel Dekker, Inc., New York, NY, 1988, p. 285).

Micelles and other Membranous Formulations. For ease of exposition the micelles and other formulations, compositions and methods in this section are discussed largely with regard to unmodified siRNA compounds. It may be understood, however, that these micelles and other formulations, compositions and methods can be practiced with other siRNA compounds, e.g., modified siRNA compounds, and such practice is within the invention. The siRNA compound, e.g., a double-stranded siRNA compound, or ssiRNA compound, (e.g., a precursor, e.g., a larger siRNA compound which can be processed into a ssiRNA compound, or a DNA which encodes an siRNA compound, e.g., a double-stranded siRNA compound, or ssiRNA compound, or precursor thereof)) composition can be provided as a micellar formulation. "Micelles" are defined herein as a particular type of molecular assembly in which amphipathic molecules are arranged in a spherical structure such that all the hydrophobic portions of the molecules are directed inward, leaving the hydrophilic portions in contact with the surrounding aqueous phase. The converse arrangement exists if the environment is hydrophobic.

A mixed micellar formulation suitable for delivery through transdermal membranes may be prepared by mixing an aqueous solution of the siRNA composition, an alkali metal $C_8$ to $C_{22}$ alkyl sulphate, and a micelle forming compounds. Exemplary micelle forming compounds include lecithin, hyaluronic acid, pharmaceutically acceptable salts of hyaluronic acid, glycolic acid, lactic acid, chamomile extract, cucumber extract, oleic acid, linoleic acid, linolenic acid, monoolein, monooleates, monolaurates, borage oil, evening of primrose oil, menthol, trihydroxy oxo cholanyl glycine and pharmaceutically acceptable salts thereof, glycerin, polyglycerin, lysine, polylysine, triolein, polyoxyethylene ethers and analogues thereof, polidocanol alkyl ethers and analogues thereof, chenodeoxycholate, deoxycholate, and mixtures thereof. The micelle forming compounds may be added at the same time or after addition of the alkali metal alkyl sulphate. Mixed micelles will form with substantially any kind of mixing of the ingredients but vigorous mixing in order to provide smaller size micelles.

In one method a first micellar composition is prepared which contains the siRNA composition and at least the alkali metal alkyl sulphate. The first micellar composition is then mixed with at least three micelle forming compounds to form a mixed micellar composition. In another method, the micellar composition is prepared by mixing the siRNA composition, the alkali metal alkyl sulphate and at least one of the micelle forming compounds, followed by addition of the remaining micelle forming compounds, with vigorous mixing.

Phenol and/or m-cresol may be added to the mixed micellar composition to stabilize the formulation and protect against bacterial growth. Alternatively, phenol and/or m-cresol may be added with the micelle forming ingredients. An isotonic agent such as glycerin may also be added after formation of the mixed micellar composition.

For delivery of the micellar formulation as a spray, the formulation can be put into an aerosol dispenser and the dispenser is charged with a propellant. The propellant, which is under pressure, is in liquid form in the dispenser. The ratios of the ingredients are adjusted so that the aqueous and propellant phases become one, i.e., there is one phase. If there are two phases, it is necessary to shake the dispenser prior to dispensing a portion of the contents, e.g., through a metered valve. The dispensed dose of pharmaceutical agent is propelled from the metered valve in a fine spray.

Propellants may include hydrogen-containing chlorofluorocarbons, hydrogen-containing fluorocarbons, dimethyl ether and diethyl ether. In certain embodiments, HFA 134a (1,1,1,2 tetrafluoroethane) may be used.

The specific concentrations of the essential ingredients can be determined by relatively straightforward experimentation. For absorption through the oral cavities, it is often desirable to increase, e.g., at least double or triple, the dosage for through injection or administration through the gastrointestinal tract.

Particles. For ease of exposition the particles, formulations, compositions and methods in this section are discussed largely with regard to modified siRNA compounds. It may be understood, however, that these particles, formulations, compositions and methods can be practiced with other siRNA compounds, e.g., unmodified siRNA compounds, and such practice is within the invention. In another embodiment, an siRNA compound, e.g., a double-stranded siRNA compound, or ssiRNA compound, (e.g., a precursor, e.g., a larger siRNA compound which can be processed into a ssiRNA compound, or a DNA which encodes an siRNA compound, e.g., a double-stranded siRNA compound, or ssiRNA compound, or precursor thereof) preparations may be incorporated into a particle, e.g., a microparticle. Microparticles can be produced by spray-drying, but may also be produced by other methods including lyophilization, evaporation, fluid bed drying, vacuum drying, or a combination of these techniques.

Pharmaceutical Compositions

The iRNA agents of the invention may be formulated for pharmaceutical use. The present invention further relates to a pharmaceutical composition comprising the dsRNA agent as defined herein. Pharmaceutically acceptable compositions comprise a therapeutically-effective amount of one or more of the dsRNA agents in any of the preceding embodiments, taken alone or formulated together with one or more pharmaceutically acceptable carriers (additives), excipient and/or diluents.

The pharmaceutical compositions may be specially formulated for administration in solid or liquid form, including those adapted for the following: (1) oral administration, for example, drenches (aqueous or non-aqueous solutions or suspensions), tablets, e.g., those targeted for buccal, sublingual, and systemic absorption, boluses, powders, granules, pastes for application to the tongue; (2) parenteral administration, for example, by subcutaneous, intramuscular, intravenous or epidural injection as, for example, a sterile solution or suspension, or sustained-release formulation; (3) topical application, for example, as a cream, ointment, or a controlled-release patch or spray applied to the skin; (4) intravaginally or intrarectally, for example, as a pessary, cream or foam; (5) sublingually; (6) ocularly; (7) transdermally; or (8) nasally. Delivery using subcutaneous or intravenous methods can be particularly advantageous.

The phrase "therapeutically-effective amount" as used herein means that amount of a compound, material, or composition comprising a compound of the invention which is effective for producing some desired therapeutic effect in at least a sub-population of cells in an animal at a reasonable benefit/risk ratio applicable to any medical treatment.

The phrase "pharmaceutically acceptable" is employed herein to refer to those compounds, materials, compositions, and/or dosage forms which are, within the scope of sound medical judgment, suitable for use in contact with the tissues of human beings and animals without excessive toxicity, irritation, allergic response, or other problem or complication, commensurate with a reasonable benefit/risk ratio.

The phrase "pharmaceutically-acceptable carrier" as used herein means a pharmaceutically-acceptable material, composition or vehicle, such as a liquid or solid filler, diluent, excipient, manufacturing aid (e.g., lubricant, talc magnesium, calcium or zinc stearate, or steric acid), or solvent encapsulating material, involved in carrying or transporting the subject compound from one organ, or portion of the body, to another organ, or portion of the body. Each carrier must be "acceptable" in the sense of being compatible with the other ingredients of the formulation and not injurious to the patient. Some examples of materials which can serve as pharmaceutically-acceptable carriers include: (1) sugars, such as lactose, glucose and sucrose; (2) starches, such as corn starch and potato starch; (3) cellulose, and its derivatives, such as sodium carboxymethyl cellulose, ethyl cellulose and cellulose acetate; (4) powdered tragacanth; (5) malt; (6) gelatin; (7) lubricating agents, such as magnesium state, sodium lauryl sulfate and talc; (8) excipients, such as cocoa butter and suppository waxes; (9) oils, such as peanut oil, cottonseed oil, safflower oil, sesame oil, olive oil, corn oil and soybean oil; (10) glycols, such as propylene glycol; (11) polyols, such as glycerin, sorbitol, mannitol and polyethylene glycol; (12) esters, such as ethyl oleate and ethyl laurate; (13) agar; (14) buffering agents, such as magnesium hydroxide and aluminum hydroxide; (15) alginic acid; (16) pyrogen-free water; (17) isotonic saline; (18) Ringer's solution; (19) ethyl alcohol; (20) pH buffered solutions; (21) polyesters, polycarbonates and/or polyanhydrides; (22) bulking agents, such as polypeptides and amino acids (23)

serum component, such as serum albumin, HDL and LDL; and (22) other non-toxic compatible substances employed in pharmaceutical formulations.

The formulations may conveniently be presented in unit dosage form and may be prepared by any methods well known in the art of pharmacy. The amount of active ingredient which can be combined with a carrier material to produce a single dosage form will vary depending upon the host being treated, the particular mode of administration. The amount of active ingredient which can be combined with a carrier material to produce a single dosage form will generally be that amount of the compound which produces a therapeutic effect. Generally, out of one hundred percent, this amount will range from about 0.1 percent to about ninety-nine percent of active ingredient, preferably from about 5 percent to about 70 percent, most preferably from about 10 percent to about 30 percent.

In certain embodiments, a formulation of the present invention comprises an excipient selected from the group consisting of cyclodextrins, celluloses, liposomes, micelle forming agents, e.g., bile acids, and polymeric carriers, e.g., polyesters and polyanhydrides; and a compound of the present invention. In certain embodiments, an aforementioned formulation renders orally bioavailable a compound of the present invention.

iRNA agent preparation can be formulated in combination with another agent, e.g., another therapeutic agent or an agent that stabilizes a iRNA, e.g., a protein that complexes with iRNA to form an iRNP. Still other agents include chelators, e.g., EDTA (e.g., to remove divalent cations such as $Mg^{2+}$), salts, RNAse inhibitors (e.g., a broad specificity RNAse inhibitor such as RNAsin) and so forth. Methods of preparing these formulations or compositions include the step of bringing into association a compound of the present invention with the carrier and, optionally, one or more accessory ingredients. In general, the formulations are prepared by uniformly and intimately bringing into association a compound of the present invention with liquid carriers, or finely divided solid carriers, or both, and then, if necessary, shaping the product.

In some cases, in order to prolong the effect of a drug, it is desirable to slow the absorption of the drug from subcutaneous or intramuscular injection. This may be accomplished by the use of a liquid suspension of crystalline or amorphous material having poor water solubility. The rate of absorption of the drug then depends upon its rate of dissolution which, in turn, may depend upon crystal size and crystalline form. Alternatively, delayed absorption of a parenterally-administered drug form is accomplished by dissolving or suspending the drug in an oil vehicle.

The compounds according to the invention may be formulated for administration in any convenient way for use in human or veterinary medicine, by analogy with other pharmaceuticals.

The term "treatment" is intended to encompass also prophylaxis, therapy and cure. The patient receiving this treatment is any animal in need, including primates, in particular humans, and other mammals such as equines, cattle, swine and sheep; and poultry and pets in general.

Double-stranded RNAi agents are produced in a cell in vivo, e.g., from exogenous DNA templates that are delivered into the cell. For example, the DNA templates can be inserted into vectors and used as gene therapy vectors. Gene therapy vectors can be delivered to a subject by, for example, intravenous injection, local administration (U.S. Pat. No. 5,328,470, which is incorporated by reference in its entirety), or by stereotactic injection (see, e.g., Chen et al. (1994) Proc. Natl. Acad. Sci. USA 91:3054-3057, which is incorporated by reference in its entirety). The pharmaceutical preparation of the gene therapy vector can include the gene therapy vector in an acceptable diluent, or can comprise a slow release matrix in which the gene delivery vehicle is imbedded. The DNA templates, for example, can include two transcription units, one that produces a transcript that includes the top strand of a dsRNA agent and one that produces a transcript that includes the bottom strand of a dsRNA agent. When the templates are transcribed, the dsRNA agent is produced, and processed into siRNA agent fragments that mediate gene silencing.

Routes of Delivery

The dsRNA agent as defined herein or a pharmaceutical composition comprising a dsRNA agent as defined herein can be administered to a subject using different routes of delivery. A composition that includes an iRNA can be delivered to a subject by a variety of routes. Exemplary routes include: intravenous, subcutaneous, topical, rectal, anal, vaginal, nasal, pulmonary, ocular.

The iRNA molecules and/or the dsRNA agent of the invention can be incorporated into pharmaceutical compositions suitable for administration. Such compositions typically include one or more species of iRNA and a pharmaceutically acceptable carrier. As used herein the language "pharmaceutically acceptable carrier" is intended to include any and all solvents, dispersion media, coatings, antibacterial and antifungal agents, isotonic and absorption delaying agents, and the like, compatible with pharmaceutical administration. The use of such media and agents for pharmaceutically active substances is well known in the art. Except insofar as any conventional media or agent is incompatible with the active compound, use thereof in the compositions is contemplated. Supplementary active compounds can also be incorporated into the compositions.

The compositions of the present invention may be administered in a number of ways depending upon whether local or systemic treatment is desired and upon the area to be treated. Administration may be topical (including ophthalmic, vaginal, rectal, intranasal, transdermal), oral or parenteral. Parenteral administration includes intravenous drip, subcutaneous, intraperitoneal or intramuscular injection, or intrathecal or intraventricular administration.

The route and site of administration may be chosen to enhance targeting. For example, to target muscle cells, intramuscular injection into the muscles of interest would be a logical choice. Lung cells might be targeted by administering the iRNA in aerosol form. The vascular endothelial cells could be targeted by coating a balloon catheter with the iRNA and mechanically introducing the DNA.

Dosage

In one aspect, the invention features a method of administering a dsRNA agent, e.g., a siRNA agent, to a subject (e.g., a human subject). In another aspect, the present invention relates to a dsRNA agent as defined herein for use in inhibiting expression of a target gene in a subject. The method or the medical use includes administering a unit dose of the dsRNA agent, e.g., a siRNA agent, e.g., double stranded siRNA agent that (a) the double-stranded part is 14-40 nucleotides (nt) long, for example, 21-23 nt, (b) is complementary to a target RNA (e.g., an endogenous or pathogen target RNA), and, optionally, (c) includes at least one 3' overhang 1-5 nucleotide long. In one embodiment, the unit dose is less than 10 mg per kg of bodyweight, or less than 10, 5, 2, 1, 0.5, 0.1, 0.05, 0.01, 0.005, 0.001, 0.0005, 0.0001, 0.00005 or 0.00001 mg per kg of bodyweight, and less than 200 nmole of RNA agent (e.g., about $4.4 \times 10^{16}$ copies) per kg of bodyweight, or less than 1500, 750, 300, 150, 75, 15, 7.5, 1.5, 0.75, 0.15, 0.075, 0.015, 0.0075, 0.0015, 0.00075, 0.00015 nmole of RNA agent per kg of bodyweight.

The defined amount can be an amount effective to treat or prevent a disease or disorder, e.g., a disease or disorder associated with the target RNA. The unit dose, for example, can be administered by injection (e.g., intravenous, subcutaneous or intramuscular), an inhaled dose, or a topical application. In some embodiments dosages may be less than 10, 5, 2, 1, or 0.1 mg/kg of body weight.

In some embodiments, the unit dose is administered less frequently than once a day, e.g., less than every 2, 4, 8 or 30 days. In another embodiment, the unit dose is not administered with a frequency (e.g., not a regular frequency). For example, the unit dose may be administered a single time.

In one embodiment, the effective dose is administered with other traditional therapeutic modalities. In one embodiment, the subject has a viral infection and the modality is an antiviral agent other than a dsRNA agent, e.g., other than a siRNA agent. In another embodiment, the subject has atherosclerosis and the effective dose of a dsRNA agent, e.g., a siRNA agent, is administered in combination with, e.g., after surgical intervention, e.g., angioplasty.

In one embodiment, a subject is administered an initial dose and one or more maintenance doses of a dsRNA agent, e.g., a siRNA agent, (e.g., a precursor, e.g., a larger dsRNA agent which can be processed into a siRNA agent, or a DNA which encodes a dsRNA agent, e.g., a siRNA agent, or precursor thereof). The maintenance dose or doses can be the same or lower than the initial dose, e.g., one-half less of the initial dose. A maintenance regimen can include treating the subject with a dose or doses ranging from 0.01 μg to 15 mg/kg of body weight per day, e.g., 10, 1, 0.1, 0.01, 0.001, or 0.00001 mg per kg of bodyweight per day. The maintenance doses are, for example, administered no more than once every 2, 5, 10, or 30 days. Further, the treatment regimen may last for a period of time which will vary depending upon the nature of the particular disease, its severity and the overall condition of the patient. In certain embodiments the dosage may be delivered no more than once per day, e.g., no more than once per 24, 36, 48, or more hours, e.g., no more than once for every 5 or 8 days. Following treatment, the patient can be monitored for changes in his condition and for alleviation of the symptoms of the disease state. The dosage of the compound may either be increased in the event the patient does not respond significantly to current dosage levels, or the dose may be decreased if an alleviation of the symptoms of the disease state is observed, if the disease state has been ablated, or if undesired side-effects are observed.

The effective dose can be administered in a single dose or in two or more doses, as desired or considered appropriate under the specific circumstances. If desired to facilitate repeated or frequent infusions, implantation of a delivery device, e.g., a pump, semi-permanent stent (e.g., intravenous, intraperitoneal, intracisternal or intracapsular), or reservoir may be advisable.

In one embodiment, the composition includes a plurality of dsRNA agent species. In another embodiment, the dsRNA agent species has sequences that are non-overlapping and non-adjacent to another species with respect to a naturally occurring target sequence. In another embodiment, the plurality of dsRNA agent species is specific for different naturally occurring target genes. In another embodiment, the dsRNA agent is allele specific.

The dsRNA agents of the invention described herein can be administered to mammals, particularly large mammals such as nonhuman primates or humans in a number of ways.

In one embodiment, the administration of the dsRNA agent, e.g., a siRNA agent, composition is parenteral, e.g., intravenous (e.g., as a bolus or as a diffusible infusion), intradermal, intraperitoneal, intramuscular, intrathecal, intraventricular, intracranial, subcutaneous, transmucosal, buccal, sublingual, endoscopic, rectal, oral, vaginal, topical, pulmonary, intranasal, urethral or ocular. Administration can be provided by the subject or by another person, e.g., a health care provider. The medication can be provided in measured doses or in a dispenser which delivers a metered dose. Selected modes of delivery are discussed in more detail below.

The invention provides methods, compositions, and kits, for rectal administration or delivery of dsRNA agents described herein In particular embodiments, the present invention relates to the dsRNA agents of the present invention for use in the methods described above.

Methods of Inhibiting Expression of the Target Gene

Embodiments of the invention also relate to methods for inhibiting the expression of a target gene. The method comprises the step of administering the dsRNA agents in any of the preceding embodiments, in an amount sufficient to inhibit expression of the target gene. The present invention further relates to a use of a dsRNA agent as defined herein for inhibiting expression of a target gene in a target cell. In a preferred embodiment, the present invention further relates to a use of a dsRNA agent for inhibiting expression of a target gene in a target cell in vitro.

Another aspect the invention relates to a method of modulating the expression of a target gene in a cell, comprising providing to said cell a dsRNA agent of this invention. In one embodiment, the target gene is selected from the group consisting of Factor VII, Eg5, PCSK9, TPX2, apoB, SAA, TTR, RSV, PDGF beta gene, Erb-B gene, Src gene, CRK gene, GRB2 gene, RAS gene, MEKK gene, JNK gene, RAF gene, Erk1/2 gene, PCNA(p21) gene, MYB gene, JUN gene, FOS gene, BCL-2 gene, hepcidin, Activated Protein C, Cyclin D gene, VEGF gene, EGFR gene, Cyclin A gene, Cyclin E gene, WNT-1 gene, beta-catenin gene, c-MET gene, PKC gene, NFKB gene, STATS gene, survivin gene, Her2/Neu gene, topoisomerase I gene, topoisomerase II alpha gene, mutations in the p73 gene, mutations in the p21(WAF1/CIP1) gene, mutations in the p27(KIP1) gene, mutations in the PPM1D gene, mutations in the RAS gene, mutations in the caveolin I gene, mutations in the MIB I gene, mutations in the MTAI gene, mutations in the M68 gene, mutations in tumor suppressor genes, and mutations in the p53 tumor suppressor gene.

In particular embodiments, the present invention relates to the dsRNA agents of the present invention for use in the methods described above.

The invention is further illustrated by the following examples, which should not be construed as further limiting. The contents of all references, pending patent applications and published patents, cited throughout this application are hereby expressly incorporated by reference.

EXAMPLES

Example 1. In Vitro Screening of siRNA Duplexes

Cell Culture and Transfections:

Human Hep3B cells or rat H.II.4.E cells (ATCC, Manassas, VA) were grown to near confluence at 37° C. in an atmosphere of 5% $CO_2$ in RPMI (ATCC) supplemented with 10% FBS, streptomycin, and glutamine (ATCC) before being released from the plate by trypsinization. Transfection was carried out by adding 14.8 µl of Opti-MEM plus 0.2 µl of Lipofectamine RNAiMax per well (Invitrogen, Carlsbad CA cat # 13778-150) to 5 µl of siRNA duplexes per well into a 96-well plate and incubated at room temperature for 15 minutes. 80 µl of complete growth media without antibiotic containing ~2 ×$10^4$ Hep3B cells were then added to the siRNA mixture. Cells were incubated for either 24 or 120 hours prior to RNA purification. Single dose experiments were performed at 10 nM and 0.1 nM final duplex concentration and dose response experiments were done using 8, 4 fold serial dilutions with a maximum dose of 10 nM final duplex concentration.

Total RNA isolation using DYNABEADS mRNA Isolation Kit (Invitrogen, part #: 610-12):

Cells were harvested and lysed in 150 µl of Lysis/Binding Buffer then mixed for 5 minute at 850rpm using an Eppendorf Thermomixer (the mixing speed was the same throughout the process). Ten microliters of magnetic beads and 80 µl Lysis/Binding Buffer mixture were added to a round bottom plate and mixed for 1 minute. Magnetic beads were captured using magnetic stand and the supernatant was removed without disturbing the beads. After removing supernatant, the lysed cells were added to the remaining beads and mixed for 5 minutes. After removing supernatant, magnetic beads were washed 2 times with 150 µl Wash Buffer A and mixed for 1 minute. Beads were capture again and supernatant removed. Beads were then washed with 150 µl Wash Buffer B, captured and supernatant was removed. Beads were next washed with 150 µl Elution Buffer, captured and supernatant removed. Beads were allowed to dry for 2 minutes. After drying, 50 µl of Elution Buffer was added and mixed for 5 minutes at 70° C. Beads were captured on magnet for 5 minutes. 40 µl of supernatant was removed and added to another 96 well plate.

cDNA Synthesis using ABI High Capacity cDNA Reverse Transcription Kit (Applied Biosystems, Foster City, CA, Cat #4368813):

A master mix of 1 µl 10X Buffer, 0.4 µl 25X dNTPs, 1 µl Random primers, 0.5 µl Reverse Transcriptase, 0.5 µl RNase inhibitor and 1.6 µl of $H_2O$ per reaction were added into 5 µl total RNA. cDNA was generated using a Bio-Rad C-1000 or S-1000 thermal cycler (Hercules, CA) through the following steps: 25° C. 10 min, 37° C. 120 min, 85° C. 5 sec, 4° C. hold.

Real Time PCR:

2 µl of cDNA were added to a master mix containing 0.5 µl GAPDH TaqMan Probe (Applied Biosystems Cat #4326317E (human) Cat # 4308313 (rodent)), 0.5 µl TTR TaqMan probe (Applied Biosystems cat # HS00174914_m1 (human) cat # Rn00562124_m1 (rat)) and 5 µl Lightcycler 480 probe master mix (Roche Cat #04887301001) per well in a 384 well plate (Roche cat # 04887301001). Real time PCR was done in a Roche LC 480 Real Time PCR machine (Roche). Each duplex was tested in at least two independent transfections and each transfection was assayed in duplicate, unless otherwise noted.

To calculate relative fold change, real time data were analyzed using the ΔΔCt method and normalized to assays performed with cells transfected with 10 nM AD-1955, or mock transfected cells. ICsos were calculated using a 4 parameter fit model using XLFit and normalized to cells transfected with AD-1955 or naïve cells over the same dose range, or to its own lowest dose. $IC_{50}$s were calculated for each individual transfection as well as in combination, where a single $IC_{50}$ was fit to the data from both transfections.

The results of gene silencing of the exemplary siRNA duplex with various motif modifications of the invention are shown in the table below.

Example 2. RNA Synthesis and Duplex Annealing

1. Oligonucleotide Synthesis:

All oligonucleotides were synthesized on an AKTAoligopilot synthesizer or an ABI 394 synthesizer. Commercially available controlled pore glass solid support (dT-CPG, 500 Å, Prime Synthesis) and RNA phosphoramidites with standard protecting groups, 5'-O-dimethoxytrityl N6-benzoyl-2'-t-butyldimethylsilyl-adenosine-3'-O—N,N'-diisopropyl-2-cyanoethylphosphoramidite, 5'-O-dimethoxytrityl-N4-acetyl-2'-t-butyldimethylsilyl-cytidine-3'-O—N,N'-diisopropyl-2-cyanoethylphosphoramidite, 5'-O-dimethoxytrityl-N2-isobutryl-2'-t-butyldimethylsilyl-guanosine-3'-O—N,N'-diisopropyl-2-cyanoethylphosphoramidite, and 5'—O-dimethoxytrityl-2'-t-butyldimethylsilyl-uridine-3'-O—N,N'-diisopropyl-2-cyanoethylphosphoramidite (Pierce Nucleic Acids Technologies) were used for the oligonucleotide synthesis unless otherwise specified. The 2'-F phosphoramidites, 5'—O-dimethoxytrityl-N4-acetyl-2'-fluro-cytidine-3'-O—N,N'-diisopropyl-2-cyanoethyl-phosphoramidite and 5'—O-dimethoxytrityl-2'-fluro-uridine-3'-O—N,N'-diisopropyl-2-cyanoethyl-phosphoramidite were purchased from (Promega). All phosphoramidites were used at a concentration of 0.2M in acetonitrile ($CH_3CN$) except for guanosine which was used at 0.2M concentration in 10% THF/ANC (v/v). Coupling/recycling time of 16 minutes was used. The activator was 5-ethyl thiotetrazole (0.75M, American International Chemicals), for the PO-oxidation Iodine/Water/Pyridine was used and the PS-oxidation PADS (2%) in 2,6-lutidine/ACN (1:1 v/v) was used.

Ligand conjugated strands were synthesized using solid support containing the corresponding ligand. For example, the introduction of carbohydrate moiety/ligand (for e.g., GalNAc) at the 3'-end of a sequence was achieved by starting the synthesis with the corresponding carbohydrate solid support. Similarly a cholesterol moiety at the 3'-end was introduced by starting the synthesis on the cholesterol support. In general, the ligand moiety was tethered to trans-4-hydroxyprolinol via a tether of choice as described in the previous examples to obtain a hydroxyprolinol-ligand moiety. The hydroxyprolinol-ligand moiety was then coupled to a solid support via a succinate linker or was converted to phosphoramidite via standard phosphitylation conditions to obtain the desired carbohydrate conjugate building blocks. Fluorophore labeled siRNAs were synthesized from the corresponding phosphoramidite or solid support, purchased from Biosearch Technologies. The oleyl lithocholic (GalNAc)$_3$ polymer support made in house at a loading of 38.6 µmol/gram. The Mannose (Man)$_3$ polymer support was also made in house at a loading of 42.0 µmol/gram.

Conjugation of the ligand of choice at desired position, for example at the 5'-end of the sequence, was achieved by coupling of the corresponding phosphoramidite to the growing chain under standard phosphoramidite coupling conditions unless otherwise specified. An extended 15 minutes coupling of 0.1M solution of phosphoramidite in anhydrous CH$_3$CN in the presence of 5-(ethylthio)-1H-tetrazole activator to a solid bound oligonucleotide. Oxidation of the internucleotide phosphite to the phosphate was carried out using standard iodine-water as reported (1) or by treatment with tert-butyl hydroperoxide/acetonitrile/water (10: 87: 3) with 10 minutes oxidation wait time conjugated oligonucleotide. Phosphorothioate was introduced by the oxidation of phosphite to phosphorothioate by using a sulfur transfer reagent such as DDTT (purchased from AM Chemicals), PADS and or Beaucage reagent The cholesterol phosphoramidite was synthesized in house, and used at a concentration of 0.1 M in dichloromethane. Coupling time for the cholesterol phosphoramidite was 16 minutes.

2. Deprotection-I (Nucleobase Deprotection)

After completion of synthesis, the support was transferred to a 100 ml glass bottle (VWR). The oligonucleotide was cleaved from the support with simultaneous deprotection of base and phosphate groups with 80 mL of a mixture of ethanolic ammonia [ammonia: ethanol (3:1)] for 6.5 h at 55° C. The bottle was cooled briefly on ice and then the ethanolic ammonia mixture was filtered into a new 250 ml bottle. The CPG was washed with 2×40 mL portions of ethanol/water (1:1 v/v). The volume of the mixture was then reduced to ~30 ml by roto-vap. The mixture was then frozen on dry ice and dried under vacuum on a speed vac.

3. Deprotection-II (Removal of 2' TBDMS group)

The dried residue was resuspended in 26 ml of triethylamine, triethylamine trihydrofluoride (TEA.3HF) or pyridine-HF and DMSO (3:4:6) and heated at 60° C. for 90 minutes to remove the tert-butyldimethylsilyl (TBDMS) groups at the 2' position. The reaction was then quenched with 50 ml of 20 mM sodium acetate and pH adjusted to 6.5, and stored in freezer until purification.

4. Analysis

The oligonucleotides were analyzed by high-performance liquid chromatography (HPLC) prior to purification and selection of buffer and column depends on nature of the sequence and or conjugated ligand.

5. HPLC Purification

The ligand conjugated oligonucleotides were purified reverse phase preparative HPLC. The unconjugated oligonucleotides were purified by anion-exchange HPLC on a TSK gel column packed in house. The buffers were 20 mM sodium phosphate (pH 8.5) in 10% CH$_3$CN (buffer A) and 20 mM sodium phosphate (pH 8.5) in 10% CH$_3$CN, 1M NaBr (buffer B). Fractions containing full-length oligonucleotides were pooled, desalted, and lyophilized. Approximately 0.15 OD of desalted oligonucleotides were diluted in water to 150 µl and then pipetted in special vials for CGE and LC/MS analysis. Compounds were finally analyzed by LC-ESMS and CGE.

6. siRNA Preparation

For the preparation of siRNA, equimolar amounts of sense and antisense strand were heated in 1×PBS at 95° C. for 5 minutes and slowly cooled to room temperature. Integrity of the duplex was confirmed by HPLC analysis.

Example 3: In Vitro Silencing Activity with Various Chemical Modifications on ANGPTL3 siRNA Cell culture and transfections Hep3B cells (ATCC, Manassas, VA) were grown to near confluence at 37° C. in an atmosphere of 5% CO$_2$ in RPMI (ATCC) supplemented with 10% FBS, streptomycin, and glutamine (ATCC) before being released from the plate by trypsinization. Transfection was carried out by adding 14.8 µl of Opti-MEM plus 0.2 µl of Lipofectamine RNAiMax per well (Invitrogen, Carlsbad CA. cat # 13778-150) to 5 µl of siRNA duplexes per well into a 96-well plate and incubated at room temperature for 15 minutes. 80 µl of complete growth media without antibiotic containing ~2×10$^4$ Hep3B cells were then added to the siRNA mixture. Cells were incubated for either 24 or 120 hours prior to RNA purification. Single dose experiments were performed at 10 nM and 0.1 nM final duplex concentration and dose response experiments were done at 10, 1, 0.5, 0.1,0.05, 0.01, 0.005, 0.001, 0.0005, 0.0001, 0.00005 and 0.00001 nM final duplex concentration unless otherwise stated.

cDNA Synthesis using ABI High Capacity cDNA Reverse Transcription Kit (Applied Biosystems, Foster City, CA, Cat #4368813)

A master mix of 2 µl 10× Buffer, 0.8 µl 25× dNTPs, 2 µl Random primers, 1 µl Reverse Transcriptase, 1 µl RNase inhibitor and 3.2 µl of H$_2$O per reaction were added into 10 µl total RNA. cDNA was generated using a Bio-Rad C-1000 or S-1000 thermal cycler (Hercules, CA) through the following steps: 25° C. 10 min, 37° C. 120 min, 85° C. 5 sec, 4° C. hold. Real time PCR 2 µl of cDNA was added to a master mix containing 0.5 µl GAPDH TaqMan Probe (Applied Biosystems Cat #4326317E), 0.5 µl ANGPTL TaqMan probe (Applied Biosystems cat # Hs00205581_ml) and 5 µl Lightcycler 480 probe master mix (Roche Cat #04887301001) per well in a 384 well 50 plates (Roche cat # 04887301001). Real time PCR was done in an ABI 7900HT Real Time PCR system (Applied Biosystems) using the ΔΔCt(RQ) assay. Each duplex was tested in two independent transfections, and each transfection was assayed in duplicate, unless otherwise noted in the summary tables.

To calculate relative fold change, real time data was analyzed using the ΔΔCt method and normalized to assays performed with cells transfected with 10 nM AD-1955, or mock transfected cells. IC$_{50}$s were calculated using a 4 parameter fit model using XLFit and normalized to cells transfected with AD-1955 or naïve cells over the same dose range, or to its own lowest dose. AD-1955 sequence, used as a negative control, targets luciferase and has the following sequence:

```
sense:
                                  (SEQ ID NO: 5)
cuuAcGcuGAGuAcuucGAdTsdT;

antisense:
                                  (SEQ ID NO: 6)
UCGAAGuACUcAGCGuAAGdTsdT.
```

The various embodiments described above can be combined to provide further embodiments. All of the U.S. patents, U.S. patent application publications, foreign patents, foreign patent applications and non-patent publications referred to in this specification are incorporated herein by reference, in their entirety. Aspects of the embodiments can be modified, if necessary to employ concepts of the various patents, applications and publications to provide yet further embodiments.

These and other changes can be made to the embodiments in light of the above-detailed description. In general, in the following claims, the terms used should not be construed to limit the claims to the specific embodiments disclosed in the specification and the claims, but should be construed to include all possible embodiments along with the full scope of equivalents to which such claims are entitled. Accordingly, the claims are not limited by the disclosure.

Example 4: Chemical Modifications on siRNAs and In Vitro Silencing of the Modified siRNAs Sense Strand Design
Ligand Design and Site of Conjugation The sense strand was conjugated to the GalNAc ligand at the 3'-position, same as the parent compound.

Sense position 11

Sense strand position 11 at the putative cleavage site (opposite AS position 11, when the sense strand is 21 nucleotides in length, and the antisense strand is 23 nucleotides in length) was modified with a nuclease sensitive modification (e.g. DNA). Data from statistical analysis across many different conjugates suggests importance of this position.

Thermal Destabilization of Sense 3'-Region (Positions 16-18):

This region was modified with thermally destabilizing modifications, such as GNA or mismatch to opposite AS-strand. Modifications of position 16 or 17 appeared to be most impactful. FIG. 1 and Table 1 highlight this position/region and the effect of thermal destabilization on in vitro efficacy. Efficacious knockdown comparable to parent template design was obtained with GNA or other thermally destabilizing modifications, such as abasic (Y34) or mismatches to the antisense strand. On the other hand, reduced silencing was generally observed for 2'-OMe or DNA modifications complementary to the opposite AS-strand.

TABLE 1

Sense strand position 17: Sequence and modifications of the siRNAs evaluated in vitro (see FIG. 1).
Table 1 discloses SEQ ID NOS 7-74, respectively, in order of columns.

| Target | Duplex ID | Sense ID | Sense (5' to 3') | AS ID | Antisense (5' to 3') | Modification | 10 nM | SD | 0.1 nM | SD |
|---|---|---|---|---|---|---|---|---|---|---|
| mTTR | AD-57727.21 | A-117799.49 | AfsasCfaGfuGfuUfcUfUfuGfcUfcUfaUfaAfL96 | A-117800.20 | usUfsaUfaGfaGfcAfagaAfcAfcUfgUfususu | parent | 3.4 | 1.2 | 12.6 | 3.6 |
| mTTR | AD-61291.1 | A-123259.1 | asascagutucdTugcucuauaaL96 | A-117800.29 | usUfsaUfaGfaGfcAfagaAfcAfcUfgUfususu | 2'-OMe | 46.3 | 6.8 | 39.3 | 13.7 |
| mTTR | AD-61297.1 | A-123260.1 | asascagutucdTugcucdTauaaL96 | A-117800.30 | usUfsaUfaGfaGfcAfagaAfcAfcUfgUfususu | DNA | 43.0 | 10.0 | 35.2 | 8.9 |
| mTTR | AD-61377.1 | A-123316.1 | asascagutucdTugcuc(Tgn)auaaL96 | A-117800.38 | usUfsaUfaGfaGfcAfagaAfcAfcUfgUfususu | GNA | 14.9 | 6.4 | 19.1 | 7.0 |
| mTTR | AD-61364.1 | A-123260.9 | asascagutucdTugcucdTauaaL96 | A-123268.5 | usdTsauagagcdAagadAcacuguususu | DNA | 27.1 | 9.6 | 43.5 | 19.9 |
| mTTR | AD-61398.1 | A-123316.9 | asascagutucdTugcuc(Tgn)auaaL96 | A-123268.6 | usdTsauagagcdAagadAcacuguususu | GNA | 13.4 | 6.2 | 17.8 | 4.8 |
| mTTR | AD-57727.41 | A-117799.131 | AfsastCfaGfuGfuUfcUfUfuGfcUfcUfaUfaAfL96 | A-117800.76 | usUfsaUfaGfaGfcAfagaAfcAfcUfgUfususu | parent | 10.3 | 3.1 | 43.0 | 5.6 |
| mTTR | AD-64426.1 | A-128287.1 | asascagutucdTugcucY34auaaL96 | A-117800.77 | usUfsaUfaGfaGfcAfagaAfcAfcUfgUfususu | abasic | 18.1 | 2.7 | 51.5 | 10.0 |
| mTTR | AD-64392.1 | A-128288.1 | asascagutucdTugcucauaaL96 | A-117800.77 | usUfsaUfaGfaGfcAfagaAfcAfcUfgUfususu | a:a mm | 33.8 | 3.4 | 50.9 | 4.9 |
| mTTR | AD-64397.1 | A-128289.1 | asascagutucdTugcucauaaL96 | A-117800.78 | usUfsaUfaGfaGfcAfagaAfcAfcUfgUfususu | c:a mm | 27.3 | 4.2 | 49.4 | 8.1 |
| mTTR | AD-64403.1 | A-128290.1 | asascagutucdTugcucgauaaL96 | A-117800.79 | usUfsaUfaGfaGfcAfagaAfcAfcUfgUfususu | g:a mm | 34.6 | 3.7 | 62.0 | 8.4 |
| mTTR | AD-64411.1 | A-128305.1 | asascagutucdTugcucUauaaL96 | A-123268.13 | usdTsauagagcdAagadAcacuguususu | RNA | 56.8 | 7.4 | 90.2 | 15.6 |
| mTTR | AD-64421.1 | A-128290.2 | asascagutucdTugcucgauaaL96 | A-123268.15 | usdTsauagagcdAagadAcacuguususu | g:a mm | 14.7 | 1.9 | 64.3 | 3.5 |
| ANG | AD-57927.7 | A-117426.25 | AfsasAfuAfuUfuGfAfUfcAfgUfcUfuUfuUfL96 | A-117427.23 | asAfsaAfaGfaCfuGfaucAfaCfAfuAfaGfususg | parent | 7.5 | 1.9 | 29.6 | 7.0 |
| ANG | AD-63144.2 | A-126526.4 | ascsauuugadTcaguc(Tgn)uuuuL96 | A-117427.28 | asAfsaAfaGfaCfuGfaucAfaCfAfuAfaGfususg | GNA at 17 | 11.9 | 7.7 | 37.5 | 12.1 |
| ANG | AD-64744.1 | A-129588.1 | ascsauuugadTcagucdTuuuuL96 | A-117427.31 | asAfsaAfaGfaCfuGfaucAfaCfAfuAfaGfususg | DNA | 16.6 | 1.4 | 57.4 | 9.8 |
| ANG | AD-64761.1 | A-129591.1 | ascsauuugadTcagucdGuuuuL96 | A-117427.34 | asAfsaAfaGfaCfuGfaucAfaCfAfuAfaGfususg | dG:A mm | 12.7 | 5.7 | 36.7 | 6.4 |
| ANG | AD-64767.1 | A-129592.1 | ascsauuugadTcagucdCuuuuL96 | A-117427.35 | asAfsaAfaGfaCfuGfaucAfaCfAfuAfaGfususg | dC:A mm | 13.2 | 5.8 | 39.0 | 9.5 |
| ANG | AD-64772.1 | A-129593.1 | ascsauuugadTcagucdAuuuuL96 | A-117427.36 | asAfsaAfaGfaCfuGfaucAfaCfAfuAfaGfususg | dA:A mm | 11.8 | 2.7 | 50.0 | 1.7 |
| ApoC3 | AD-57787.1 | A-117361.23 | GfscsUfuAfaAfaGfGfaCfaGfuUfaAfuucuL96 | A-129546.17 | asGfsaAfuAfcUfgUfcccUfuUfuAfaGfcsasa | parent | 8.2 | 3.8 | 45.0 | 24.0 |
| ApoC3 | AD-64823.1 | A-129551.2 | gscsuuaaaaggdGacaguauucuL96 | A-129546.21 | asGfsaAfuAfcUfgUfcccUfuUfuAfaGfcsasa | 2'-OMe | 33.1 | 7.7 | 110.5 | 9.3 |
| ApoC3 | AD-64806.1 | A-129556.1 | gscsuuaaaaggdGacagudAuucuL96 | A-129546.26 | asGfsaAfuAfcUfgUfcccUfuUfuAfaGfcsasa | DNA | 52.1 | 13.8 | 103.8 | 28.7 |
| ApoC3 | AD-64794.1 | A-129554.4 | gscsuuaaaaggdGacagu(Agn)uucuL96 | A-129546.24 | asGfsaAfuAfcUfgUfcccUfuUfuAfaGfcsasa | GNA | 8.7 | 2.1 | 50.2 | 15.9 |
| ApoC3 | AD-64829.1 | A-129560.2 | gscsuuaaaaggdGacagugucuL96 | A-129546.30 | asGfsaAfuAfcUfgUfcccUfuUfuAfaGfcsasa | g:u mm | 25.5 | 10.3 | 75.8 | 18.4 |
| ApoC3 | AD-64789.1 | A-129561.2 | gscsuuaaaaggdGacagucucuL96 | A-129546.31 | asGfsaAfuAfcUfgUfcccUfuUfuAfaGfcsasa | c:u mm | 21.8 | 6.1 | 39.7 | 5.7 |
| ApoC3 | AD-64795.1 | A-129562.2 | gscsuuaaaaggdGacaguuucuL96 | A-129546.32 | asGfsaAfuAfcUfgUfcccUfuUfuAfaGfcsasa | u:u mm | 19.9 | 6.3 | 54.2 | 10.1 |
| ApoC3 | AD-64812.1 | A-129557.4 | gscsuuaaaaggdGacagudTuucuL96 | A-129546.27 | asGfsaAfuAfcUfgUfcccUfuUfuAfaGfcsasa | dT:u mm | 18.2 | 6.1 | 59.3 | 19.9 |
| TTRSC | AD-64474.1 | A-128493.1 | UfsgsGfgAfuUfuCfAfUfgUfaAfccAfaGfaL96 | A-128494.1 | usCfsuUfgGfuUfgUfaAfaCfuCfCfcAfasuc | parent | 17.3 | 10.2 | 72.2 | 13.5 |
| TTRSC | AD-64493.1 | A-128505.1 | usgsggauuucadTguaaccaagaL96 | A-128494.8 | usCfsuUfgGfuUfgUfaAfaCfuCfCfcAfasuc | 2'-OMe | 43.3 | 25.6 | 100.1 | 9.6 |
| TTRSC | AD-64460.1 | A-128507.1 | usgsggauuucadTguaacdCaagaL96 | A-128494.10 | usCfsuUfgGfuUfgUfaAfaCfuCfCfcAfasuc | DNA | 18.7 | 6.2 | 81.0 | 8.7 |
| TTRSC | AD-64455.1 | A-128506.1 | usgsggauuucadTguaac(Cgn)aagaL96 | A-128494.9 | usCfsuUfgGfuUfgUfaAfaCfuCfCfcAfasuc | GNA | 26.1 | 12.9 | 68.0 | 14.8 |
| TTRSC | AD-64482.1 | A-128511.1 | usgsggauuucadTguaacuaagaL96 | A-128494.14 | usCfsuUfgGfuUfgUfaAfaCfuCfCfcAfasuc | u:g mm | 19.0 | 8.2 | 96.2 | 14.5 |
| TTRSC | AD-64488.1 | A-128512.1 | usgsggauuucadTguaacaagaL96 | A-128494.15 | usCfsuUfgGfuUfgUfaAfaCfuCfCfcAfasuc | a:g mm | 19.4 | 4.1 | 72.6 | 7.9 |
| TTRSC | AD-64494.1 | A-128513.1 | usgsggauuucadTguaacgaagaL96 | A-128494.16 | usCfsuUfgGfuUfgUfaAfaCfuCfCfcAfasuc | g:g mm | 29.8 | 11.6 | 93.9 | 13.1 |

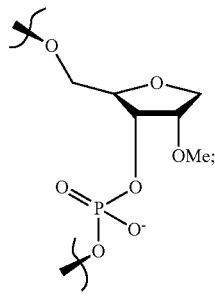

Y34

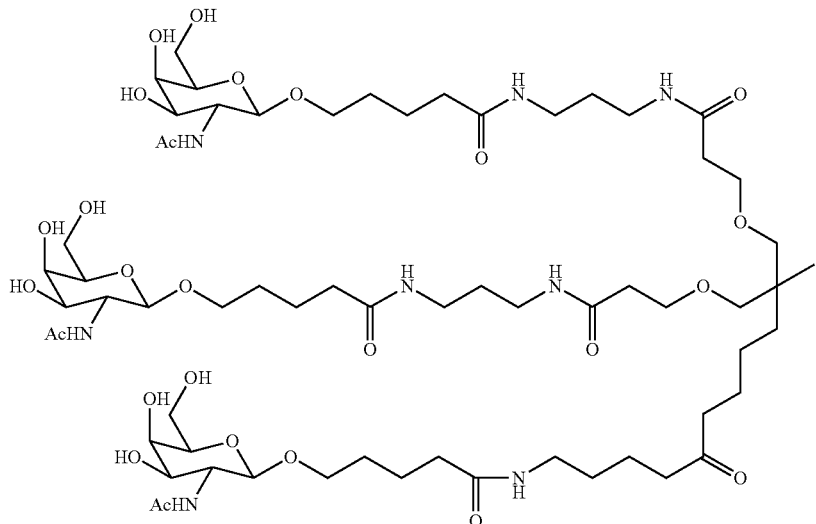

L96

Figure 2:
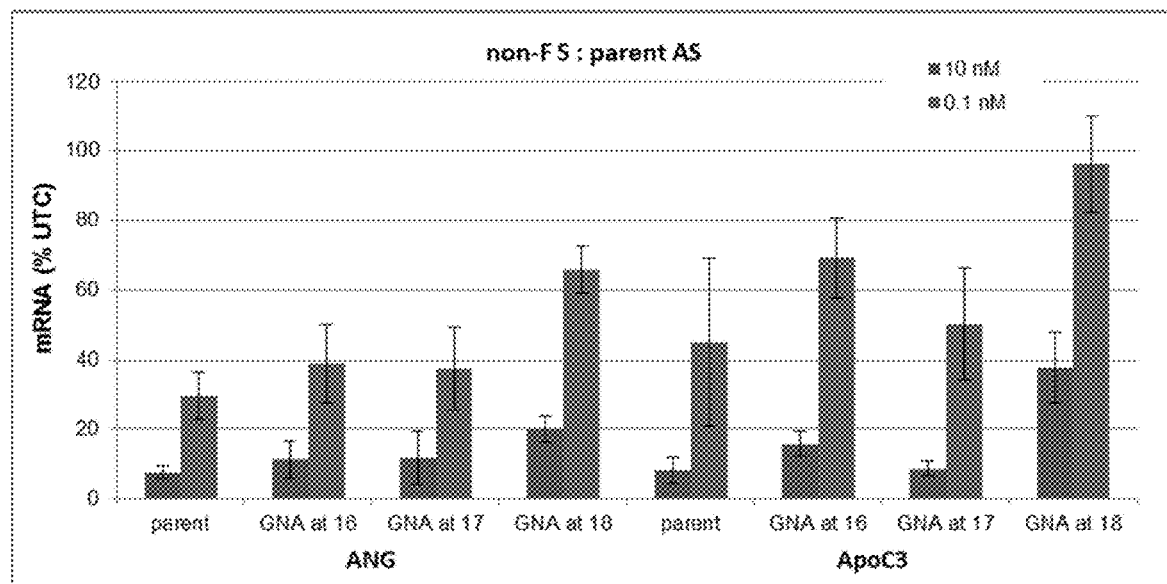
FIG. 2 is a chart showing positional effect on in vitro efficacy of thermally destabilizing GNA modification across the sense strand positions 16-18 evaluated at 10 nM and 0.1 nM concentrations.

FIG. 2 and Table 2 showed the positional effect of the thermally destabilizing modification GNA across the 3'-region (positions 16-18). The results indicate that GNA modifications in positions 16 and 17 showed good efficacy, similar to the parent design, while GNA in position 18 showed a decrease in activity.

TABLE 2

Positional effect of thermal destabilization with GNA: Sequence and modifications of the siRNAs evaluated in vitro (see FIG. 2). Table 2 discloses SEQ ID NOS 75-90, respectively, in order of columns.

| Target | Duplex ID | Sense ID | Sense (5' to 3') | AS ID |
|---|---|---|---|---|
| ANG | AD-57927.7 | A-117426.25 | AfscsAfuAfuUfuGfAfUfcAfgUfcUfuUfuUfL96 | A-117427.23 |
| ANG | AD-64766.1 | A-129585.1 | ascsausuuugadTcagu(Cgn)uuuuuL96 | A-117427.27 |
| ANG | AD-63144.2 | A-126526.4 | ascsausuuugadTcaguc(Tgn)uuuuL96 | A-117427.28 |
| ANG | AD-64777.1 | A-129586.1 | ascsauauuugadTcagucu(Tgn)uuuL96 | A-117427.29 |
| ApoC3 | AD-64787.1 | A-117361.23 | GfscsUfuAfaAfaGfGfGfaCfaGfuAfuUfcUfL96 | A-129546.17 |
| ApoC3 | AD-64788.1 | A-129553.5 | gscsuuaaaagzdGacag(Tgn)auucuL96 | A-129546.23 |
| ApoC3 | AD-64794.1 | A-129554.4 | gscsuuaaaaggdGacagu(Agn)uucuL96 | A-129546.24 |
| ApoC3 | AD-64800.1 | A-129555.2 | gscsuuaaaaggdGacagua(Tgn)ucuL96 | A-129546.25 |

| Target | Antisense (5' to 3') | Modification | 10 nM | SD | 0.1 nM | SD |
|---|---|---|---|---|---|---|
| ANG | asAfsaAfaGfaCfuGfaucAfaAfuAfuGfususg | parent | 7.5 | 1.9 | 29.6 | 7.0 |
| ANG | asAfsaAfaGfaCfuGfaucAfaAfuAfuGfususg | GNA at 16 | 11.3 | 5.4 | 38.8 | 11.3 |
| ANG | asAfsaAfaGfaCfuGfaucAfaAfuAfuGfususg | GNA at 17 | 11.9 | 7.7 | 37.5 | 12.1 |
| ANG | asAfsaAfaGfaCfuGfaucAfaAfuAfuGfususg | GNA at 18 | 19.8 | 3.7 | 65.8 | 6.8 |
| ApoC3 | asGfsaAfuAfcUfgUfcccUfuUfuAfaGfcsasa | parent | 8.2 | 3.8 | 45.0 | 24.0 |
| ApoC3 | asGfsaAfuAfcUfgUfcccUfuUfuAfaGfcsasa | GNA at 16 | 15.9 | 3.4 | 69.2 | 11.6 |
| ApoC3 | asGfsaAfuAfcUfgUfcccUfuUfuAfaGfcsasa | GNA at 17 | 8.7 | 2.1 | 50.2 | 15.9 |
| ApoC3 | asGfsaAfuAfcUfgUfcccUfuUfuAfaGfcsasa | GNA at 18 | 37.9 | 10.2 | 96.0 | 13.8 |

TABLE 3

Figure 3:
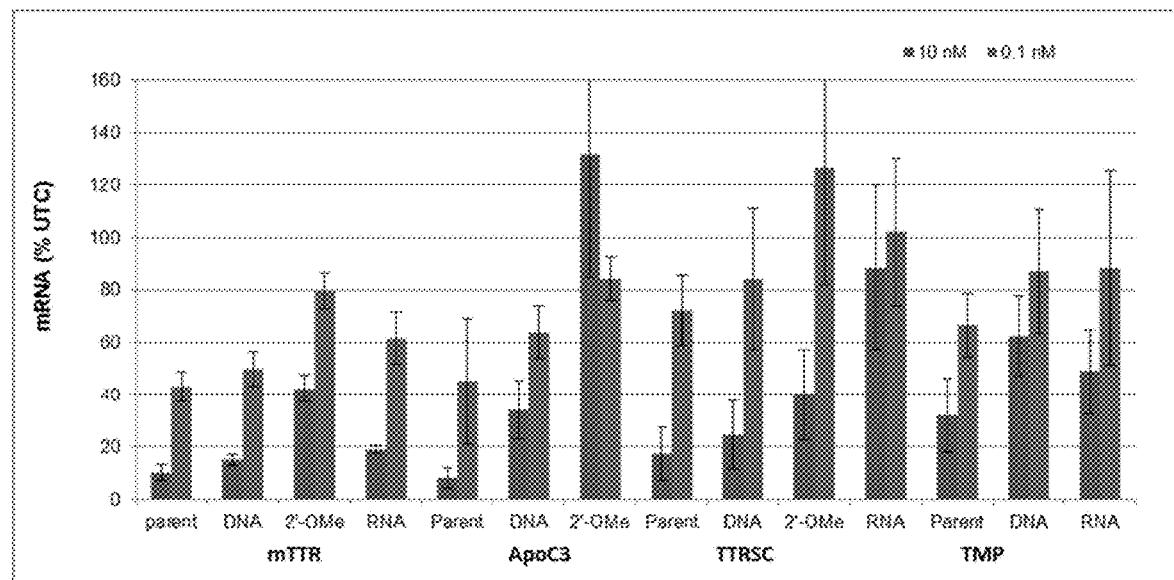
FIG. 3 is a chart showing the effect of modifications at the antisense strand position 2 on in vitro efficacy of siRNAs targeting mTTR, ApoC3, TTRSC and TMP evaluated at 10 nM and 0.1 nM concentrations.

Antisense position 2: Sequence and modifications of the siRNAs evaluated in vitro (see FIG. 3).
Table 3 discloses SEQ ID NOS 91-118, respectively, in order of columns.

| Target | Duplex ID | Sense ID | Sense (5' to 3') | AS ID |
|---|---|---|---|---|
| mTTR | AD-57727.41 | A-117799.131 | AfsasCfaGfuGfuUfCfUfuGfcUfcUfaUfaAfL96 | A-117800.71 |
| mTTR | AD-61398.5 | A-123316.21 | asascaguguuucdTugcuc(Tgn)auaaL96 | A-123268.11 |
| mTTR | AD-64393.1 | A-123316.23 | asascaguguuucdTugcuc(Tgn)auaaL96 | A-128294.1 |
| mTTR | AD-64415.1 | A-123316.27 | asascaguguuucdTugcuc(Tgn)auaaL96 | A-128298.1 |
| ApoC3 | AD-64787.1 | A-117361.23 | GfscsUfuAfaAfaGfGfGfaCfaGfuAfuUfcUfL96 | A-129546.17 |
| ApoC3 | AD-64802.1 | A-117361.33 | GfscsUfuAfaAfaGfGfGfaCfaGfuAfuUfcUfL96 | A-129571.5 |
| ApoC3 | AD-64790.1 | A-117361.31 | GfscsUfuAfaAfaGfGfGfaCfaGfuAfuUfcUfL96 | A-129569.2 |
| TTRSC | AD-64474.1 | A-128493.1 | UfsgsGfgAfuUfuCfAfUfgUfaAfcCfaAfgAfL96 | A-128494.1 |
| TTRSC | AD-64472.1 | A-128493.14 | UfsgsGfgAfuUfuCfAfUfgUfaAfcCfaAfgAfL96 | A-128525.1 |
| TTRSC | AD-64484.1 | A-128493.16 | UfsgsGfgAfuUfuCfAfUfgUfaAfcCfaAfgAfL96 | A-128527.1 |
| TTRSC | AD-64496.1 | A-128493.18 | UfsgsGfgAfuUfuCfAfUfgUfaAfcCfaAfgAfL96 | A-128529.1 |
| TMP | AD-60940.7 | A-122745.22 | CfsusGfgUfaUfuUfCfCfuAfgGfgUfaCfaAfL96 | A-122746.24 |
| TMP | AD-64567.1 | A-126602.4 | csusgguauuucdCuaggg(Tgn)acaaL96 | A-129067.1 |
| TMP | AD-64586.1 | A-126602.7 | csusgguauuucdCuaggg(Tgn)acaaL96 | A-129085.1 |

| Target | Antisense (5' to 3') | Modification | 10 nM | SD | 0.1 nM | SD |
|---|---|---|---|---|---|---|
| mTTR | usUfsaUfaGfaGfcAfagaAfcAfcUfgUfususu | parent | 10.3 | 3.1 | 43.0 | 5.6 |
| mTTR | usdTsauagagcdAagadAcacuguususu | DNA | 15.3 | 2.2 | 49.6 | 6.5 |
| mTTR | ususauagagcdAagadAcacuguususu | 2'-OMe | 42.4 | 5.0 | 79.7 | 6.8 |
| mTTR | usUsauagagcdAagadAcacuguususu | RNA | 19.1 | 1.6 | 61.7 | 9.9 |
| ApoC3 | asGfsaAfuAfcUfgUfcccUfuUfuAfaGfcsasa | Parent | 8.2 | 3.8 | 45.0 | 24.0 |
| ApoC3 | asdGsaauacugdTcccdTuuuaagcsasa | DNA | 34.2 | 11.0 | 63.9 | 10.1 |
| ApoC3 | asgsaauacugdTcccdTuuuaagcsasa | 2'-OMe | 131.8 | 46.9 | 84.5 | 8.5 |
| TTRSC | usCfsuUfgGfuUfaCfaugAfaAfuCfcCfasusc | Parent | 17.3 | 10.2 | 72.2 | 13.5 |
| TTRSC | usdCsuugguuadCaugdAaaucccasusc | DNA | 24.8 | 13.1 | 84.3 | 27.0 |
| TTRSC | uscsuugguuadCaugdAaaucccasusc | 2'-OMe | 39.9 | 17.1 | 126.6 | 44.6 |
| TTRSC | usCsuugguuadCaugdAaaucccasusc | RNA | 88.6 | 31.5 | 102.3 | 28.1 |
| TMP | usUfsgUfaCfcCfuAfggaAfaUfaCfcAfgsasg | Parent | 32.2 | 14.2 | 66.5 | 12.1 |
| TMP | usdTsguacccudAggadAauaccagsasg | DNA | 62.4 | 15.4 | 87.2 | 23.8 |
| TMP | usUsguacccudAggadAauaccagsasg | RNA | 48.9 | 16.0 | 88.6 | 37.1 |

Antisense Strand Design

AS position 2

This position has been identified by statistical analysis of large conjugate dataset and positional walks through AS-strand as being sensitive to sterically demanding 2'-modifications incl. 2'-OMe. The inventors found, however, that several modifications, including DNA, in some cases RNA, as well as other modifications without steric bulk at the 2'-position can be well tolerated in the context of non-F designs. The results from in vitro silencing studies are summarized in FIG. 3 and Table 3, indicating that DNA as well as RNA at position 2 generally maintains activity of the non-F designs similar to the parent template design, while 2'-OME is generally not well tolerated and leads to reduced activity.

AS position 14

Figure 4:
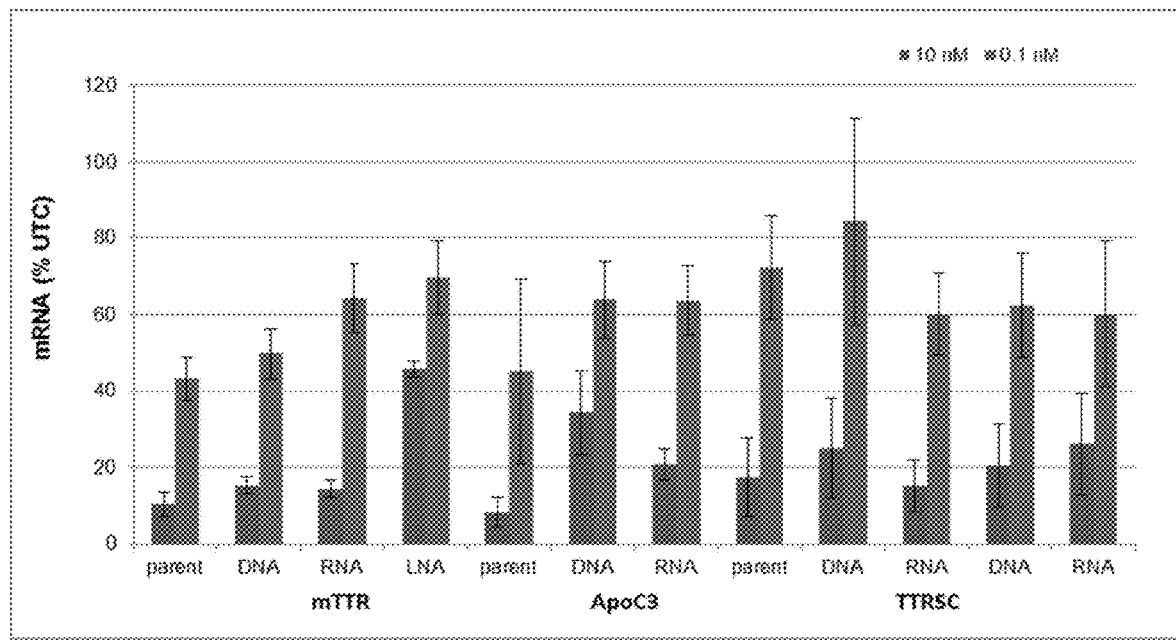
FIG. 4 is a chart showing the effect of modifications at the antisense stand position 14 on in vitro efficacy of siRNAs targeting mTTR, ApoC3, and TTRSC evaluated at 10 nM and 0.1 nM concentrations.

This position has been identified by statistical analysis of large conjugate dataset and positional walks through AS-strand as being sensitive to sterically demanding 2'-modifications incl. 2'-OMe. It has been found, however, that several modifications, including DNA, in some cases RNA, as well as other modifications without steric bulk at the 2'-position can be well tolerated in the context of non-F designs. The results from in vitro silencing studies are summarized in FIG. 4 and Table 4, indicating that DNA as well as RNA at position 14 generally maintains activity of the non-F designs similar to the parent template design, while 2'-OME is generally not well tolerated and leads to reduced activity.

TABLE 4

Antisense position 14: Sequence and chemistries of siRNAs evaluated in vitro (see FIG. 4).
Table 4 discloses SEQ ID NOS 119-142, respectively, in order of columns.

| Target | Duplex ID | Sense ID | Sense (5' to 3') | AS ID |
|---|---|---|---|---|
| mTTR | AD-57727.41 | A-117799.131 | AfsasCfaGfuGfuUfCfUfuGfcUfcUfaUfaAfL96 | A-117800.71 |
| mTTR | AD-61398.5 | A-123316.21 | asascaguguuucdTugcuc(Tgn)auaaL96 | A-123268.11 |
| mTTR | AD-64273.2 | A-123316.29 | asascaguguuucdTugcuc(Tgn)auaaL96 | A-128300.1 |
| mTTR | AD-64132.1 | A-123316.13 | asascaguguuucdTugcuc(Tgn)auaaL96 | A-128243.1 |
| ApoC3 | AD-64787.1 | A-117361.23 | GfscsUfuAfaAfaGfGfGfaCfaGfuAfuUfcUfL96 | A-129546.17 |
| ApoC3 | AD-64802.1 | A-117361.33 | GfscsUfuAfaAfaGfGfGfaCfaGfuAfuUfcUfL96 | A-129571.5 |
| ApoC3 | AD-64831.1 | A-117361.38 | GfscsUfuAfaAfaGfGfGfaCfaGfuAfuUfcUfL96 | A-129576.2 |

TABLE 4-continued

Antisense position 14: Sequence and chemistries of siRNAs evaluated in vitro (see FIG. 4).
Table 4 discloses SEQ ID NOS 119-142, respectively, in order ofcolumns.

| | | | | |
|---|---|---|---|---|
| TTRSC | AD-64474.1 | A-128493.1 | UfsgsGfgAfuUfuCfAfUfgUfaAfcCfaAfgAfL96 | A-128494.1 |
| TTRSC | AD-64472.1 | A-128493.14 | UfsgsGfgAfuUfuCfAfUfgUfaAfcCfaAfgAfL96 | A-128525.1 |
| TTRSC | AD-64458.1 | A-128493.19 | UfsgsGfgAfuUfuCfAfUfgUfaAfcCfaAfgAfL96 | A-128530.1 |
| TTRSC | AD-64515.1 | A-128506.2 | usgsggauuucadTguaac(Cgn)aagaL96 | A-128525.2 |
| TTRSC | AD-64504.1 | A-128506.4 | usgsggauuucadTguaac(Cgn)aagaL96 | A-128530.2 |

| Target | Antisense (5' to 3') | Modification | 10 nM | SD | 0.1 nM | SD |
|---|---|---|---|---|---|---|
| mTTR | usUfsaUfaGfaGfcAfagaAfcAfcUfgUfususu | parent | 10.3 | 3.1 | 43.0 | 5.6 |
| mTTR | usdTsauagagcdAagadAcacuguususu | DNA | 15.3 | 2.2 | 49.6 | 6.5 |
| mTTR | usdTsauagagcdAagaAcacuguususu | RNA | 14.3 | 2.2 | 64.2 | 9.0 |
| mTTR | usdTsauagagcdAaga(Aln)cacuguususu | LNA | 45.5 | 2.1 | 69.5 | 9.6 |
| ApoC3 | asGfsaAfuAfcUfgUfcccUfuUfuAfaGfcsasa | parent | 8.2 | 3.8 | 45.0 | 24.0 |
| ApoC3 | asdGsaauacugdTcccdTuuuaagcsasa | DNA | 34.2 | 11.0 | 63.9 | 10.1 |
| ApoC3 | asdGsaauacugdTcccUuuuaagcsasa | RNA | 20.7 | 4.2 | 63.8 | 9.0 |
| TTRSC | usCfsuUfgGfuUfaCfaugAfaAfuCfcCfasuse | parent | 17.3 | 10.2 | 72.2 | 13.5 |
| TTRSC | usdCsuugguuadCaugdAasucccasusc | DNA | 24.8 | 13.1 | 84.3 | 27.0 |
| TTRSC | usdCsuugguuadCaugAaaucccasusc | RNA | 15.1 | 6.6 | 60.0 | 10.8 |
| TTRSC | usdCsuugguuadCaugdAaaucccasusc | DNA | 20.5 | 10.8 | 62.3 | 13.8 |
| TTRSC | usdCsuugguuadCaugAaaucccasusc | RNA | 26.0 | 13.2 | 60.2 | 19.1 |

TABLE 5

Sequence and chemistry of the siRNAs targeting mTTR used in the in vivo study in mice.
Table 5 discloses SEQ ID NOS 143-148, respectively, in order of columns.

| Duplex ID | Sense ID | Sense (5' to 3') | AS ID | Antisense (5' to 3') | Design |
|---|---|---|---|---|---|
| AD-57727 | A-117799 | AfsasCfaGfuGfuUfCfUfuGfcUfcUfaUf | A-117800 | usUfsaUfaGfaGfcAfagaAfcAfcUfgUfususu | parent |
| AD-61398 | A-123316 | asascaguguucdTugcuc(Tgn)auaaL96 | A-123268 | usdTsauagagcdAagadAcacuguususu | parent non-F motif |
| AD-64273 | A-123316 | asascaguguucdTugcuc(Tgn)auaaL96 | A-128300 | usdTsauagagcdAagaAcacuguususu | AS: RNA at 14 |

In Vivo Evaluation siRNAs Targeting mTTR

Figure 5:
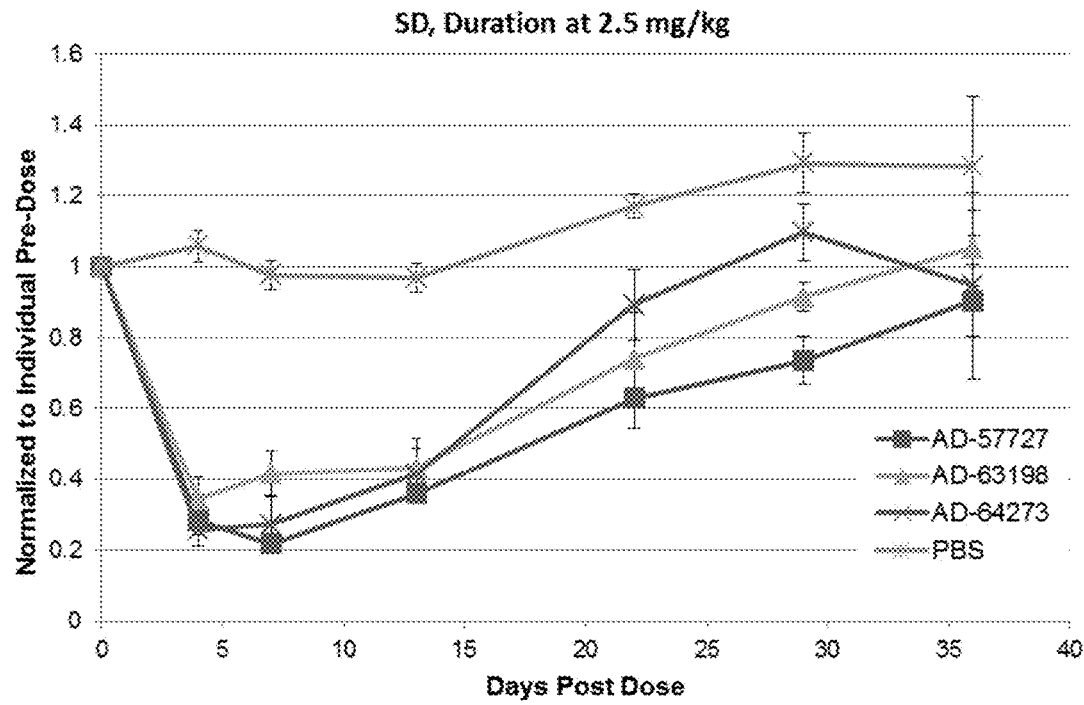
FIG. 5 is a graph showing the mTTR silencing in mice after a single SC dose of 2.5 mg/kg.
Figure 6:
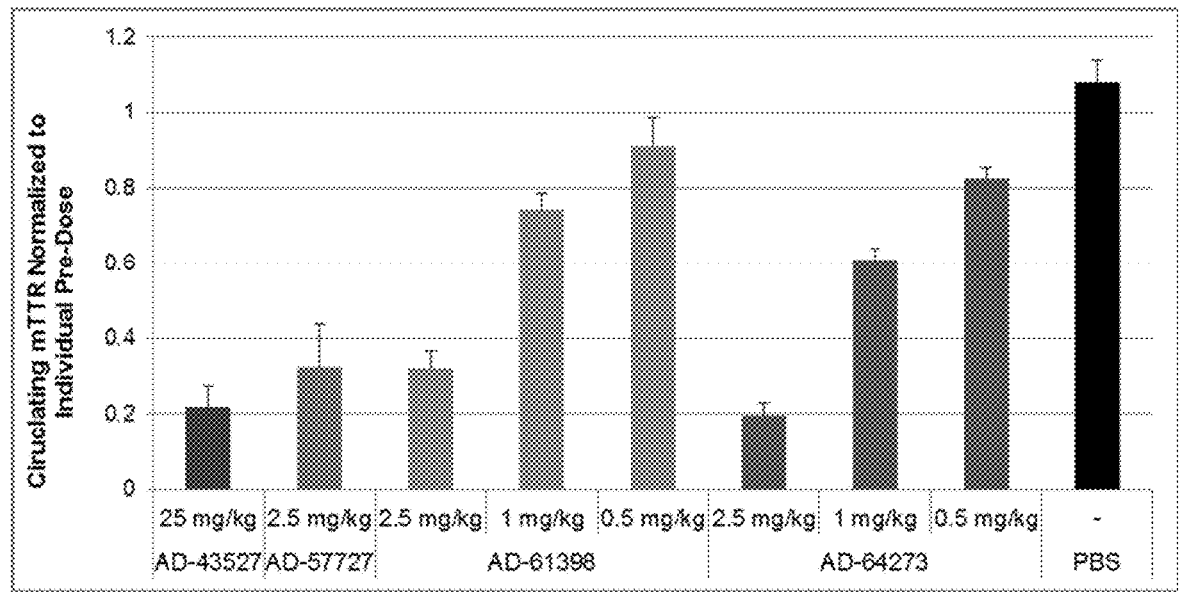
FIG. 6 is a chart showing the dose response of non-F siRNAs AD-61398 and AD-64273 compared to parent 2 PS (AD-43527) and 6 PS (AD-57727); single SC dose, protein levels measured 96 h post dose.
Figure 7:
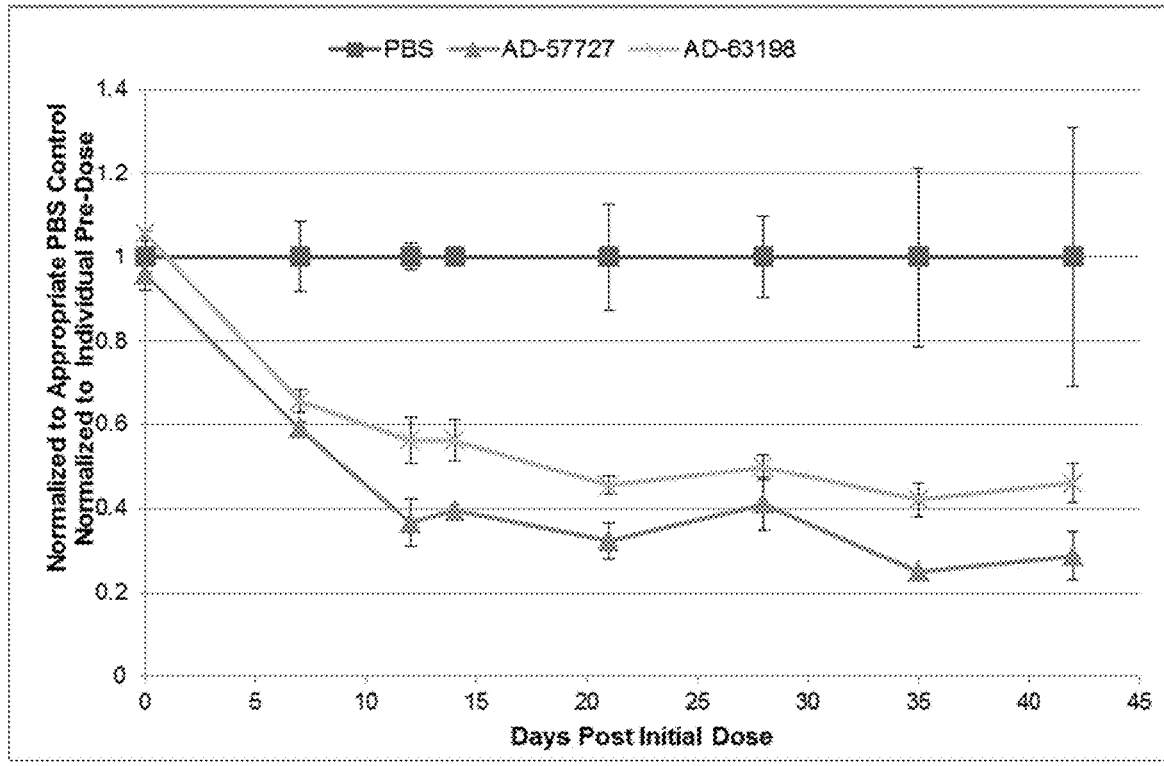
FIG. 7 is a chart showing the mTTR protein reduction in plasma after QW SC dosing of 1 mg/kg siRNA in mice comparing non-F AD-61398 with parent motif: AD-57727.

Animals (n=3/group) were administered a single siRNA dose of 2.5 mg/kg and FVII serum protein levels were measured pre-dose and at days 4, 7, 13, 22, 29, and 36. FIG. 5 shows the FVII protein concentration-time profile for the 2 non-F siRNAs AD-61398 and 64273 in comparison to the parent compound AD-57727. In FIG. 6, the mTTR protein reduction 96 h post dose is shown for the two non-F siRNAs at three different dose levels in comparison to the parent compounds. In FIG. 7, the profiles of mTTR serum protein reduction is shown for repeat-dose regimen (1 mg/kg, QW) up to day 42 (total of 6 doses).

Overall, the studies indicate that the non-F siRNAs AD-61398 and AD-642733 exhibited in vivo efficacy and potency similar to the parent template design.

siRNAs Targeting TMPRSS6

TABLE 6

Sequence and chemistry of siRNAs targeting TMPRSS6. Table 6 discloses
SEQ ID NOS 149-158, respectively, in order ofcolumns.

| Duplex ID | Sense ID | Sense sequence | AS ID | Antisense sequence | 10 nM Avg | SD | 0.1 nM Avg | SD |
|---|---|---|---|---|---|---|---|---|
| AD-60940.7 | A-122745.22 | CfsusGfgUfaUfuUfCfCfuAfgGfgUfaCfaAfL96 | A-122746.24 | usUfsgUfaCfcCfuAfggaAfaUfaCfcAfgsasg | 32.2 | 14.2 | 66.5 | 12.1 |
| AD-64604.1 | A-129074.2 | csusgguadTuucdCuaggg(Tgn)acaaL96 | A-129085.2 | usUsguacccudAggadAauaccagsasg | 25.2 | 10.2 | 57.5 | 27.9 |
| AD-64601.1 | A-129073.1 | csusggudAuuucdCuaggg(Tgn)acaaL96 | A-129067.6 | usdTsguacccudAggadAauaccagsasg | 23.0 | 8.6 | 74.7 | 17.7 |

TABLE 6-continued

Sequence and chemistry of siRNAs targeting TMPRSS6. Table 6 discloses
SEQ ID NOS 149-158, respectively, in order of columns.

| Duplex ID | Sense ID | Sense sequence | AS ID | Antisense sequence | 10 nM Avg | SD | 0.1 nM Avg | SD |
|---|---|---|---|---|---|---|---|---|
| AD-64567.1 | A-126602.4 | csusgguauuucdCuaggg(Tgn)acaaL96 | A-129067.1 | usdTsguacccudAggadAauaccagsasg | 62.4 | 15.4 | 87.2 | 23.8 |
| AD-64569.1 | A-129083.1 | csusgguadTuucdCuagggdAacaaL96 | A-129067.16 | usdTsguacccudAggadAauaccagsasg | 49.7 | 9.4 | 49.4 | 19.7 |

Figure 8:
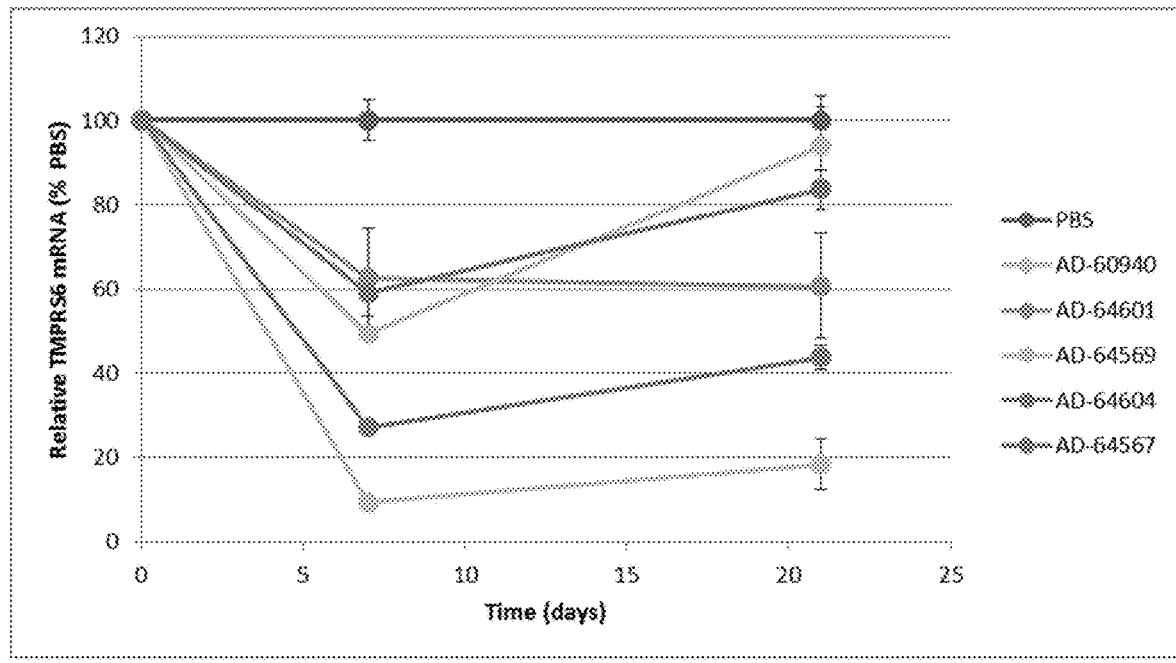
FIG. 8 is a chart showing the silencing of TMPRSS6 mRNA after single SC dose of 3 mg/kg in mice (n=3/group): comparison of non-F designs with parent motif: AD-60490.

The results indicate different in vivo efficacies of the non-F designs depending on the exact placement of modifications and combination of sense and AS-strands. Although the in vitro data suggests that the non-F compounds had similar potency/efficacy to the parent, the non-F compound AD-64604, found to be most active in vivo was still significantly less efficacious than the parent AD-60940 (see FIG. 8).

Figure 9:
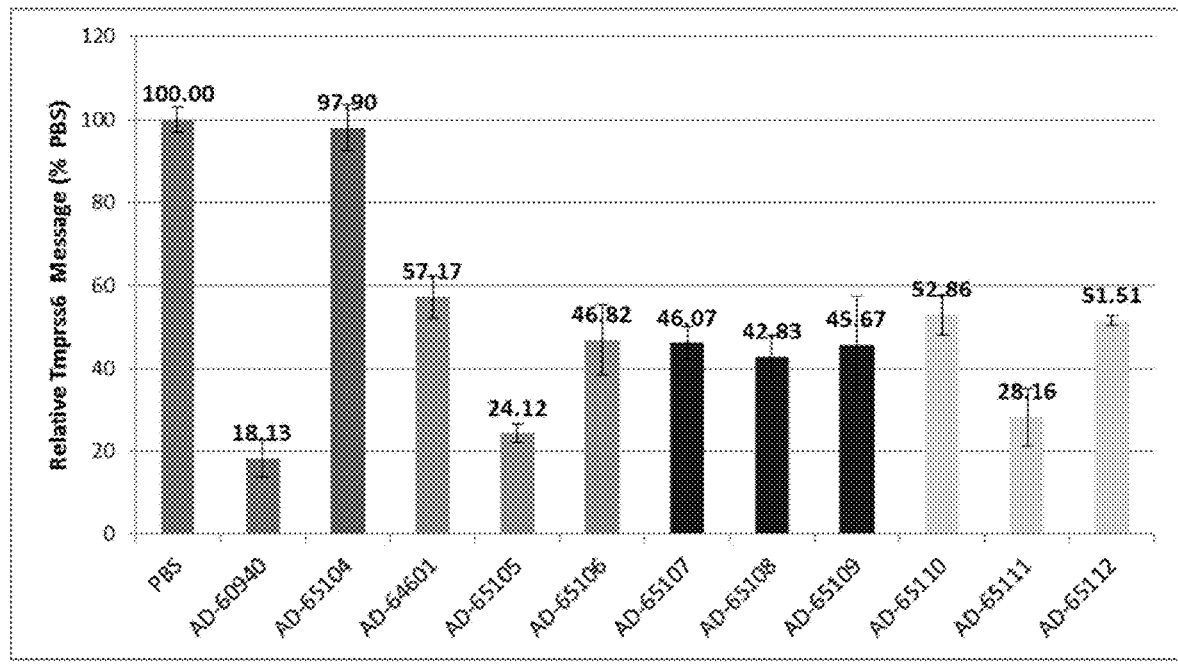
FIG. 9 is a graph showing the silencing of TMPRSS6 mRNA 7 days after single SC dose of 3 mg/kg in mice (n=3/group): comparison of non-F designs with parent motif: AD-60490.

Further refinements of the non-F design were made and evaluated as summarized in Table 7. FIG. 9 shows the TMPRSS6 mRNA silencing in liver 7 days post a single SC dose of 3 mg/kg.

TABLE 7

Sequence and chemistry of 2$^{nd}$ set of siRNAs targeting TMPRSS6. Table 7 discloses SEQ ID NOS 159-178, respectively, in order of columns.

| Duplex ID | Sense ID | Sense (5' to 3') | AS ID | Antisense (5' to 3') | Parent |
|---|---|---|---|---|---|
| AD-64601 | A-129073.2 | csusggudAuuucdCuaggg(Tgn)acaaL96 | A-129067.18 | usdTsguacccudAggadAauaccagsasg | AD-60940 |
| AD-65105 | A-129073.2 | csusggudAuuucdCuaggg(Tgn)acaaL96 | A-129085.5 | usUsguacccudAggadAauaccagsasg | AD-60940 |
| AD-65106 | A-129073.2 | csusggudAuuucdCuaggg(Tgn)acaaL96 | A-129086.2 | usdTsguacccudAsggadAsauaccagsasg | AD-60940 |
| AD-65107 | A-129710.1 | csusggudAuuucdCuagggdAacaaL96 | A-129067.18 | usdTsguacccudAggadAauaccagsasg | AD-60940 |
| AD-65108 | A-129710.1 | csusggudAuuucdCuagggdAacaaL96 | A-129085.5 | usUsguacccudAggadAauaccagsasg | AD-60940 |
| AD-65109 | A-129710.1 | csusggudAuuucdCuagggdAacaaL96 | A-129086.2 | usdTsguacccudAsggadAsauaccagsasg | AD-60940 |
| AD-65110 | A-130024.1 | csusggudAsuuucdCuaggg(Tgn)acaaL96 | A-129067.18 | usdTsguacccudAggadAauaccagsasg | AD-60940 |
| AD-65111 | A-130024.1 | csusggudAsuuucdCuaggg(Tgn)acaaL96 | A-129085.5 | usUsguacccudAggadAauaccagsasg | AD-60940 |
| AD-65112 | A-130024.1 | csusggudAsuuucdCuaggg(Tgn)acaaL96 | A-129086.2 | usdTsguacccudAsggadAsauaccagsasg | AD-60940 |
| AD-65104 | A-129875.1 | usgsguadTuuccdTagggudTcaaaL96 | A-129876.1 | usdTsuguacccdTaggdAaauaccasgsa | AD-61002 |

As shown in FIG. 9, the refinement yielded at least one non-F compound (AD-65105) with in vivo efficacy comparable to the parent (AD-60940). The compound contains a sense strand with DNA at positions 6 and 11 and an antisense strand with RNA in position 2 and DNA in positions 10, 14.

Motif Design

When designing the motif, the sense strand was conjugated to the GalNAc ligand at the 3'-position, using the same procedure as used with the parent compound. Additional motifs were designed according to the embodiments of the invention. Representative sequences are listed in Table 8.

TABLE 8

Representative sequences (Table 8 discloses SEQ ID NOS 179-190, respectively, in order of appearance)

| Duplex Name | Strand | Sequences |
|---|---|---|
| AD-57727 | S | AfsasCfaGfuGfuUfCfUfuGfcUfcUfaUfaAfL96 |
| | AS | usUfsaUfaGfaGfAfagaAfcAfcUfgUfususu |
| AD-57553 | S | GfscsUfuAfaAfaGfGfGfaCfaGfuAfuUfcUfL96 |
| | AS | asGfsaAfuAfcUfgUfcccUfuUfuAfaGfCsAfsa |
| AD-63042 | S | CfsusUfgCfuCfuAfUfAfaAfcCfgUfgUfuAfL96 |
| | AS | usAfsaCfaCfgGfuUfuauAfgAfgCfaAfgsasa |
| AD-63085 | S | UfscsCfuCfuGfaUfGfGfuCfaAfaGfuCfcUfL96 |
| | AS | asGfsgAfcUfuUfgAfccaUfcAfgAfgGfascsa |
| AD-65703 | S | gscsuuaaAfaGfGfGfacaguauucaL96 |
| | AS | usGfsaauAfcUfGfucccUfuUfuaagcsasa |

TABLE 8-continued

Representative sequences (Table 8 discloses SEQ ID NOS 179-190, respectively, in order of appearance)

| Duplex Name | Strand | Sequences |
|---|---|---|
| AD-65704 | S | gscsuuaaAfaGfGfGfacaguauucaL96 |
| | AS | usGfsaauacugucccUfuuuaagcsasa |

In Vitro Results

Figure 10:
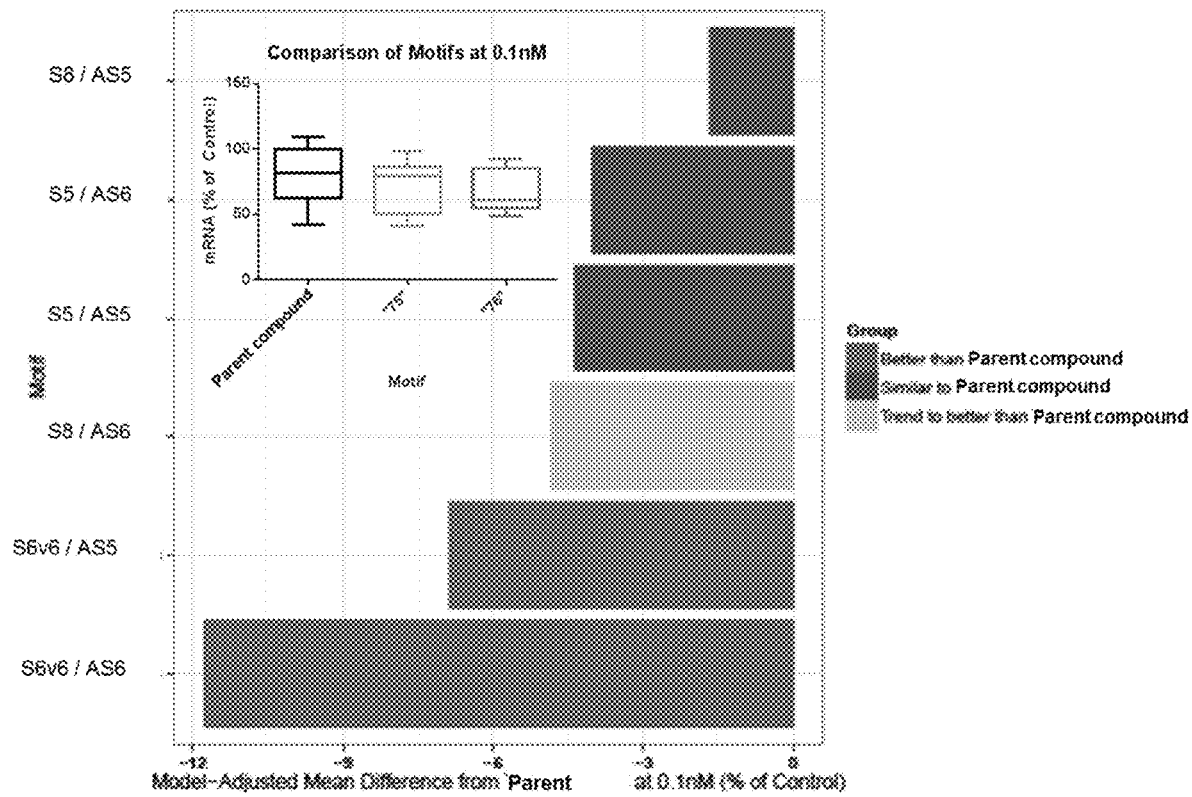
FIG. 10 shows the in vitro activity results of two motifs, Motif 1 and Motif 2, activity compared to the parent compound AD-57727.

As shown in FIG. 10, across ten sequences representing three targets, two motifs, Motif 1 (six phosphorothioate internucleotide linkage modifications to the sense and antisense strand; four 2'-F modifications at positions 7 and 9-11 of the sense strand from 5'-end of the sense strand, and four 2'-F modifications at positions 2, 6, 14, and 16 of the antisense strand from 5'-end of the antisense strand) and Motif 2 (six phosphorothioate internucleotide linkage modifications to the sense and antisense strand; four 2'-F modifications at positions 7 and 9-11 of the sense strand from 5'-end of the sense strand, and six 2'-F modifications at positions 2, 6, 8-9, 14, and 16 of the antisense strand from 5'-end of the antisense strand) were found to have a statistically significant improvement in activity compared to the parent compound AD-57727.

In Vivo Evaluation

Figure 11:
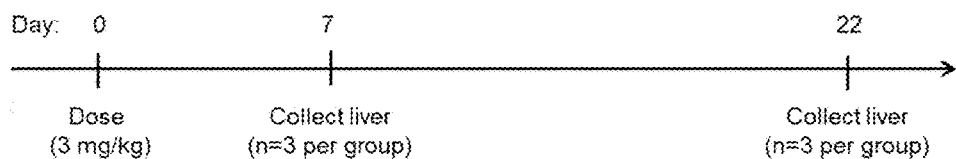
FIG. 11 shows the in vivo evaluation of the silencing activity of the siRNAs targeting mTTR.

The target silencing of the siRNAs was assessed by qPCR. The performance of the motifs was assessed to target mTTR. Animals (n=3/group) were administered a single siRNA dose of 3 mg/kg and liver levels were measured, first at pre-dose, and then at days 7 and 22, as shown in FIG. 11.

Figure 12:
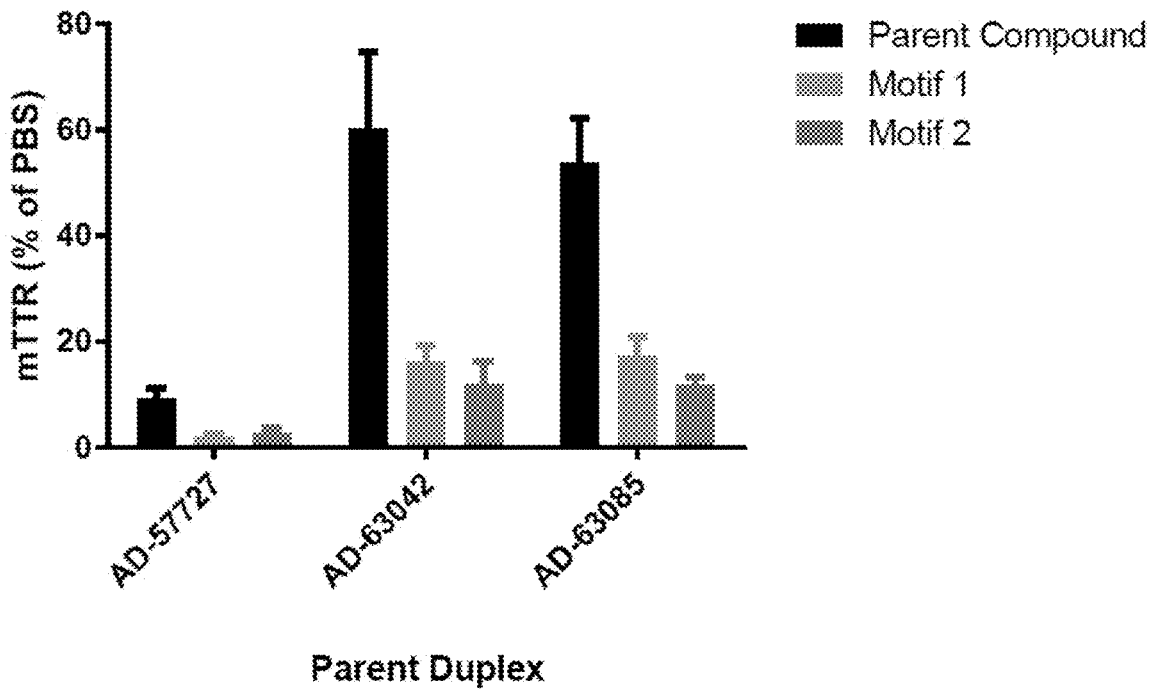
FIG. 12 shows the enhanced activity with Stability Enhanced Conjugate Chemistry (SEC-C), where the liver was assessed for activity (mRNA) on day 7 post-dosing.

FIG. 12 shows the enhanced activity with Stability Enhanced Conjugate Chemistry (SEC-C), where the liver was assessed for activity (mRNA) on day 7 post-dosing. Animals received single dose of 3 mg/kg (s.c.). The data demonstrates the impact of the motifs on the in vivo activity.

Figure 13:
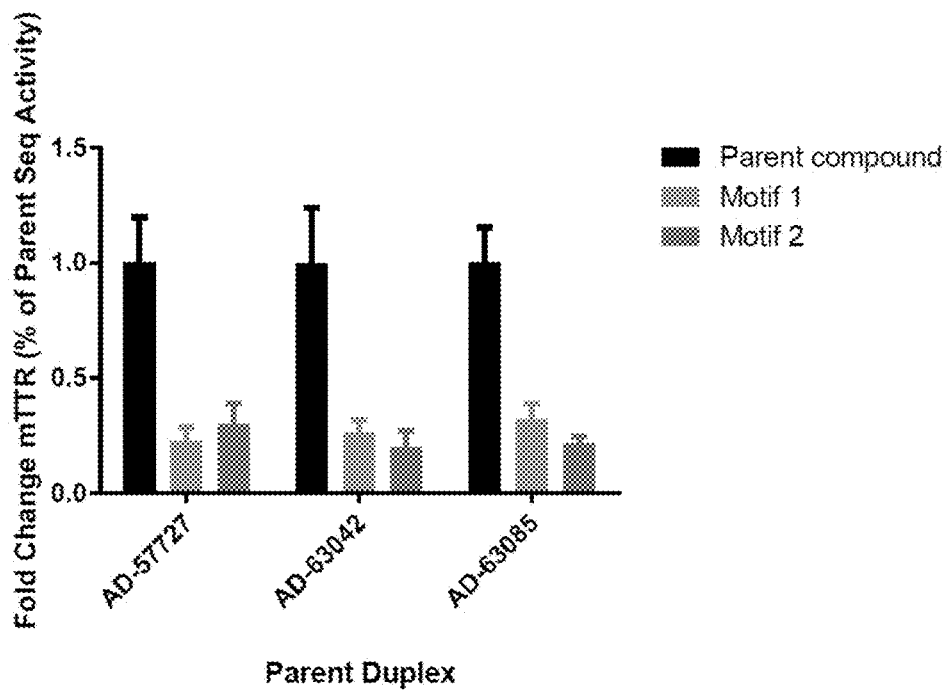
FIG. 13 depicts a chart showing an approximate 4-fold improvement in activity with new motifs (Motifs 1 and 2) compared to the parent compound.

FIG. 13 shows enhanced activity (approximately 4-fold improvement in activity) with the new motifs (Motifs 1 and 2) compared to the parent compound with data assessed on day 7 post-dosing. The data demonstrates the impact of the motifs on the in vivo activity. The fold improvement is consistent across sequences.

Figure 14:
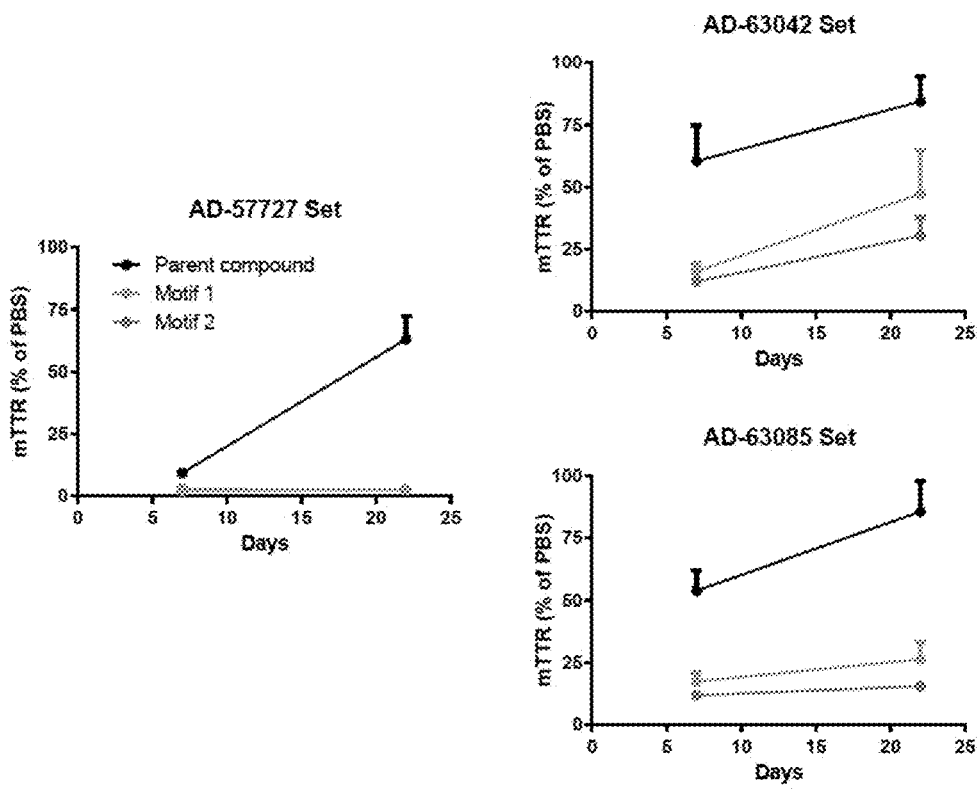
FIG. 14 depicts a chart showing a markedly improved duration of Motif 1 and Motif 2 across three sequences.

FIG. 14 shows markedly improved duration across all three sequences, which demonstrate that the new motifs exhibit enhanced duration.

Figure 15:
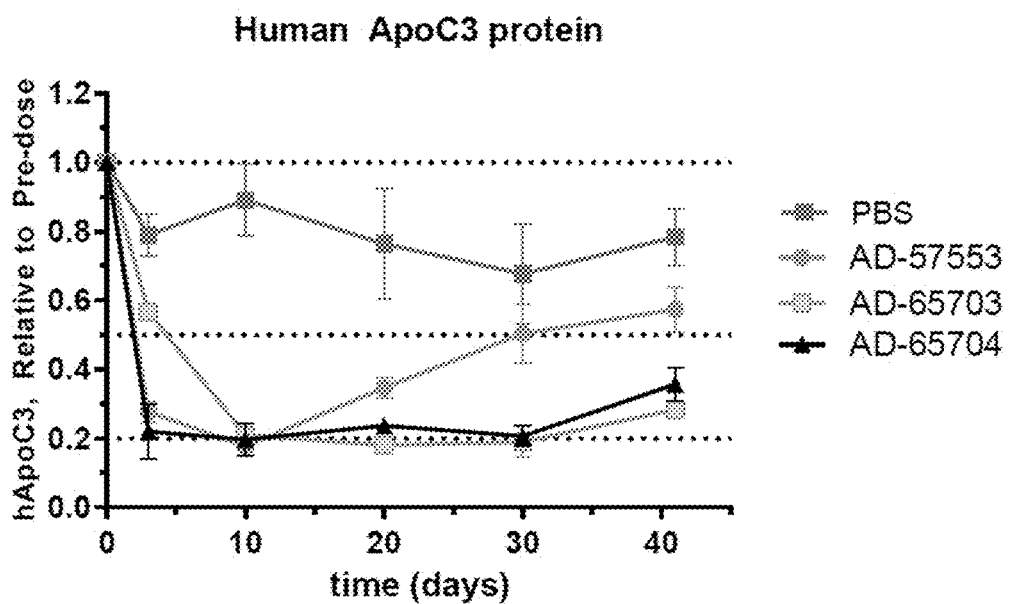
FIG. 15 depicts a graph showing the results of ApoC3-GalNAc3 SAR, at single 3 mg/kg SC dose hAAV $1 \times 10^{11}$ GC/mouse.

FIG. 15 shows the results of ApoC3-GalNAc3 SAR, at single 3 mg/kg SC dose
hAAV $1 \times 10^{11}$ GC/mouse.

Example 5: VP and $PS_2$ Modifications at the 5' end of the Antisense Strand

Set forth below are exemplary protocols for the synthesis of oligonucleotides containing 5'-vinyl phosphonate (VP) and the synthesis of oligonucleotides containing 2'-deoxythymidine linked via a phosphorodithioate ($PS_2$) linkage at the 5'-end of the oligonucleotide. One skilled in the art will appreciate that these same or similar techniques can be used to synthesize similar oligonucleotides. Other synthesis techniques known to those of skill in the art may also be used to synthesis and prepare these and similar oligonucleotides and the modifications, including, but not limited to, synthesis techniques disclosed in Whittaket et al., "Stereoselective synthesis of highly functionalized P-stereogenic nucleosides via palladium-catalyzed P-C cross-coupling reactions," Tetrahedron Letters 49: 6984-87 (2008); Zhao and Caruthers, "Synthesis and Preliminary Biochemical Studies with 5'-Deoxy-5'-methylidyne Phosphonate Linked Thymidine Oligonucleotides," Tetrahedron Letters 37(35): 6239-42 (1996); and U.S. Patent Application Publication No. 2013/0084576, all of which are herein incorporated by reference in their entirety.

Protocols for Synthesis of Oligonucleotides Containing 5'-Vinyl Phosphonate

Introduction of Pivaloyloxymethyl-(POM)-Protected VP

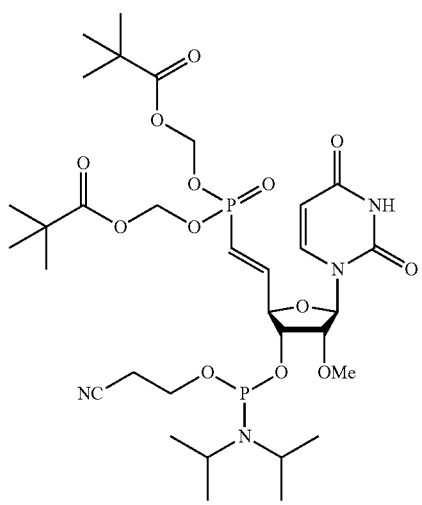

Coupling and oxidation: Coupling of amidite was performed under standard synthesis conditions using 0.25M 5-(ethylthio)-1H-tetrazole in acetonitrile for activation. Standard thiolation protocols with either 3-(dimethylaminomethylene) amino-3H-1,2,4-dithiazole-5-thione (DDTT) or phenylacetyl disulfide (PADS) were performed to convert the phosphite triester into a phosphorothioate linkage. Since the vinyl phosphonate building block does not contain a DMT protecting group at the 5'-position, the final detritylation step was omitted.

Deprotection and cleavage: After synthesis the vinylphosphonate-containing oligonucleotides were deprotected in a 3:1 mixture of aqueous $NH_3$ and EtOH with the addition of 1-2.5% by volume of 40% methylamine solution for 5 hours at 60° C. or 16 hours at 35° C.

Introduction of Ethyl-Protected VP

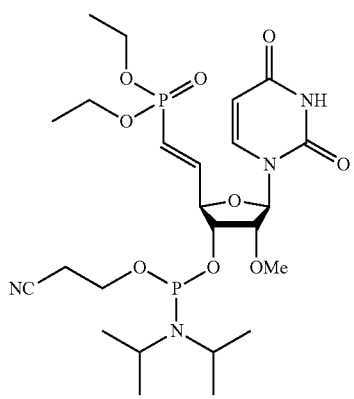

Coupling and oxidation: Coupling of amidite was performed under standard synthesis conditions using 0.25M 5-(ethylthio)-1H-tetrazole in acetonitrile for activation. Standard thiolation protocols with either 3-(dimethylaminomethylene) amino-3H-1,2,4-dithiazole-5-thione (DDTT) or phenylacetyl disulfide (PADS) were performed to oxidize the phosphite triester and introduce the phosphorothioate linkage. Since the vinyl phosphonate building block does not contain a DMT protecting group at the 5'-position, the final detritylation step was omitted.

Deprotection and cleavage: A solution of acetonitrile (ACN) and pyridine (Pyr) 50:1 (v/v) was prepared and 3A molecular sieves were added to keep the mixture as dry as possible. To this mixture, 3.5 mL (5g) of trimethylsilyl iodide (TMSI) was added for every 135 mL of the ACN/Pyr solution. This solution must be prepared fresh and has a maximum shelf life of one day. Next, a 0.5 M solution of mercaptoethanol in 1:1 (v/v) acetonitrile-triethylamine was prepared and 3A molecular sieves were added. With the 5'-VP-containing oligonucleotide on resin and in the synthesis column, the TMSI solution was slowly added at about 5-10 CV and allowed to react for 15 min. This step was repeated twice resulting in a total exposure time of approximately 45 minutes. Subsequently, the resin was washed extensively with ACN followed by a flow of the mercaptoethanol solution of about 5-10 column volumes over the column, allowed to react for 10 min. This step was repeated once for a total exposure of 20 minutes. After another extensive wash with ACN, the support-bound oligonucleotide was deprotected and cleaved from the support using standard conditions.

Protocol for Synthesis of Oligonucleotides Containing 2'-Dexoythymidine Linked via a Phosphorodithioate Linkage at the 5'-End of the Oligonucleotide

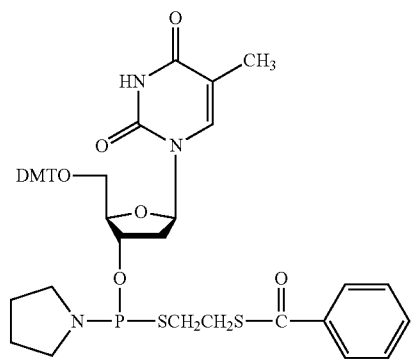

Coupling and oxidation: the phosphoramidite solution was prepared from commercially available dT-thiophosphoramidite (Glen Research) according to the manufacturer's protocol in dry acetonitrile at a concentration of 0.15 M. Coupling was performed under standard conditions using 0.25M 5-(ethylthio)-1H-tetrazole in acetonitrile for a total coupling time of 17 minutes. The capping step was omitted from the synthesis cycle. Oxidation (thiolation) was performed using 3-(dimethylaminomethylene) amino-3H-1,2, 4-dithiazole-5-thione (DDTT) by extending reagent deliver and reaction times to 3×10 minutes. Final detritylation was performed using standard synthesis conditions Deprotection and cleavage: the solid support (on column) was washed with 0.5M piperidine in ACN (2×15 minutes exposure time) before the resin was transferred to suitable container and treated under standard conditions (e.g. 3:1 aqueous NH:EtOH solution for 5 hours at 60° C. or 16 hours at 35° C.) to cleave from solid support and deprotect the oligonucleotide.

The rest procedures for the oligonucleotide synthesis process are similar to the procedures described in Example 2.

Figure 16:
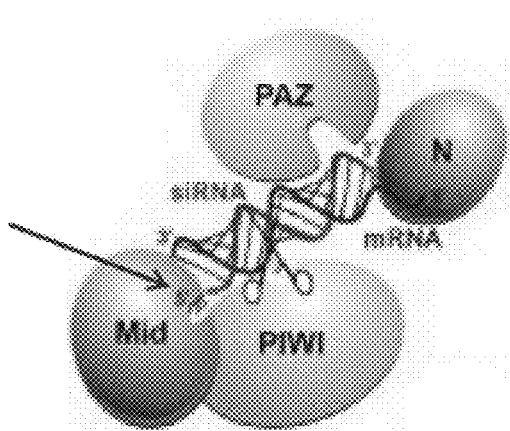
FIG. 16 illustrates a schematic of Ago2 loaded siRNA and the 5'-vinylphosphonate (5'-VP), a modified phosphate mimicking stable phosphate. The 5'-phosphonate is added by cytosolic C1p1 kinase and acts as critical anchor for Ago2 loading.
Figure 16:
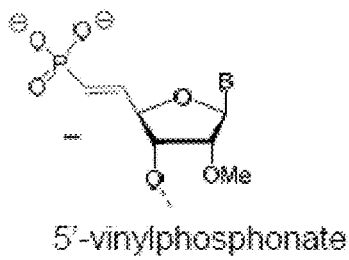

FIG. 16 illustrates a schematic of Ago2 loaded siRNA. Generally, 5'-phosphate-functionalized siRNAs (ESC chemistry) exhibit improved in vitro activity. For instance, ~80% of sequences tested have shown improved inherent potency when transfected in vitro, and ~30% show about a 10-fold $IC_{50}$ benefit. In vivo, however, 5'-phosphate is rapidly lost in endo/lysome compartments. A modified phosphate, mimicking stable phosphate, the 5'-vinylphosphonate (5'-VP), is also shown in FIG. 16 attached to the 5' end of a modified oligonucleotide. This phosphonate was originally designed by Merck.

An embodiment of this invention is directed towards 5'-end-modifications for potency improvements (RISC loading). The end modifications provide stable phosphate mimics and promote endogenous phosphorylation.

Figure 17:
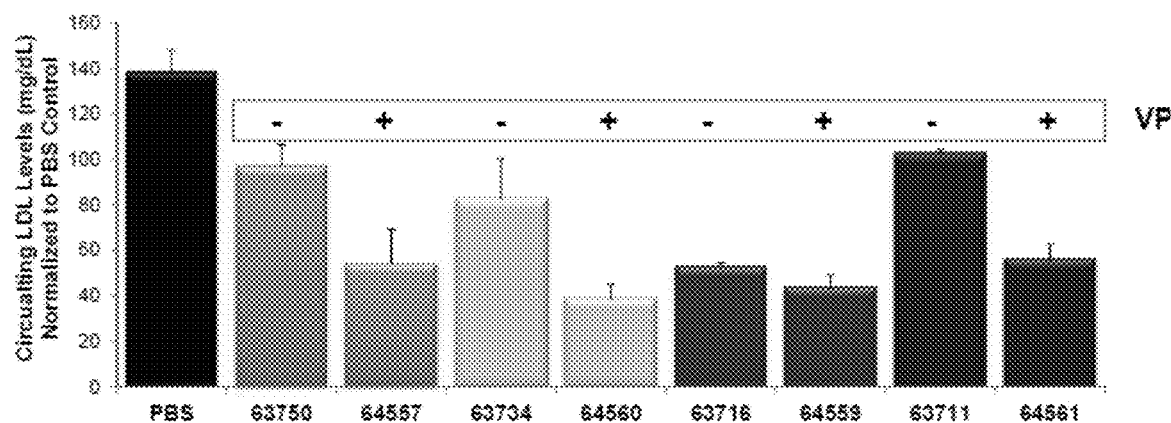
FIG. 17 depicts a chart showing how the presence of 5'-VP generally improves in vivo activity. The evaluations were carried out on four different ApoB sequences. The LDL levels 7 days post single SC dose of 3 mg/kg were analyzed for the four conjugates (with or without 5'-VP modification).

FIG. 17 depicts a chart showing how the presence of 5'-VP generally improves in vivo activity, based on the evaluation of four different ApoB sequences. The LDL levels 7 days post single SC dose of 3 mg/kg were analyzed for the four conjugates (with or without 5'-VP modification). As seen from the chart, a 3-fold improvement in $ED_{50}$ is seen in certain ApoB sequences. The in vivo benefit has been confirmed with additional compounds/targets including ApoC3, Tmpssr6, and TTR. The ApoB sequences are listed in Table 9.

TABLE 9

(Table 9 discloses SEQ ID NOS 191-206, respectively, in order of columns)

| Duplex Name | Sense strand (5'-3') | Antisense strand (5'3') |
| --- | --- | --- |
| AD 63750 | AfsasAfgAfgGfuGfUfAfuGfgCfu UfcAfaAfL96 | usUfsuGfaAfgCfcAfuacAfcCfuCfu Ufuscsa |
| AD 64557 | AfsasAfgAfgGfuGfUfAfuGfgCfu UfcAfaAfL96 | VPusUfsuGfaAfgCfcAfuacAfcCfuC fuUfuscsa |
| AD 63734 | CfsusGfgAfcAfuUfCfAfgAfaCfa AfgAfaAfL96 | usUfsuCfuUfgUfuCfugaAfuGfuCfc Afgsgsg |
| AD 64560 | CfsusGfgAfcAfuUfCfAfgAfaCfa AfgAfaAfL96 | VPusUfsuCfuUfgUfuCfugaAfuGfu CfcAfgsgsg |
| AD 63716 | UfsgsUfgAfcAfaAfUfAfuGfgGfc AfuCfaAfL96 | usUfsgAfuGfcCfcAfuauUfuGfuCfa Cfasasa |

TABLE 9-continued (Table 9 discloses SEQ ID NOS 191-206, respectively, in order of columns)

| Duplex Name | Sense strand (5'-3') | Antisense strand (5'3') |
|---|---|---|
| AD 64559 | UfsgsUfgAfcAfaAfUfAfuGfgGfc AfuCfaAfL96 | VPusUfsgAfuGfcCfcAfuauUfuGfu CfaCfasasa |
| AD 63711 | CfscsUfgGfaCfaUfUfCfaGfaAfc AfaGfaAfL96 | usUfscUfuGfuUfcUfgaaUfgUfcCfa Gfgsgsu |
| AD 64561 | CfscsUfgGfaCfaUfUfCfaGfaAfc AfaGfaAfL96 | VPusUfscUfuGfuUfcUfgaaUfgUfcC faGfgsgsu |

Figure 18:
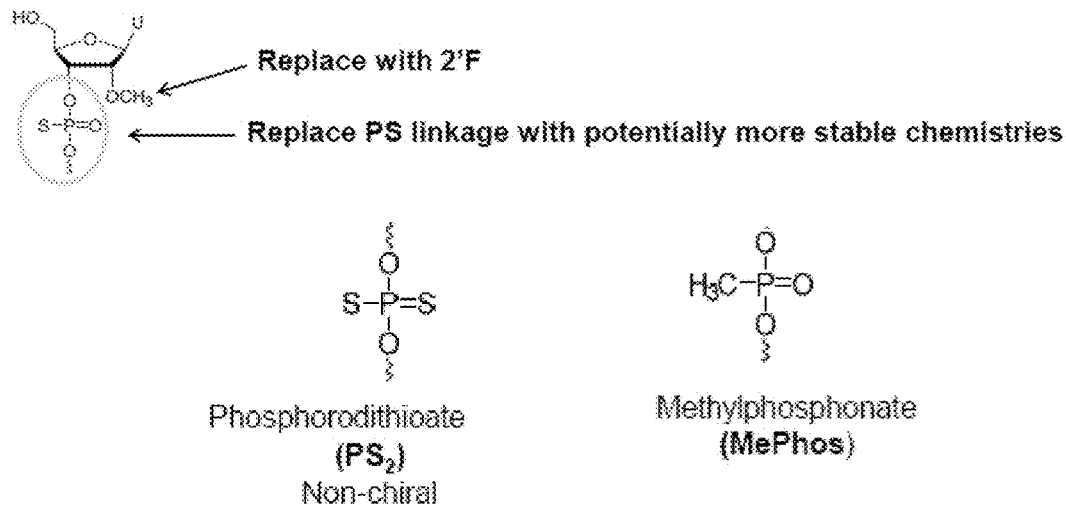
FIG. 18 depicts different chemical modifications that can replace the PS linkage and provide more stable chemistries, including phosphorodithioate ($PS_2$), and methylphosphonate (MePhos), which promotes endogenous phosphorylation.

FIG. 18 depicts different chemical modifications that can replace the PS linkage, including phosphorodithioate (PS$_2$), and methylphosphonate (MePhos), which promotes endogenous phosphorylation. Modified siRNAs are generally not good substrates for Clp1 kinase, perhaps because of the interference by 2'OMe modification at the first nucleotide of the AS strand. However, the 2'-OMe modification along with phosphorothioate linkage are desirable for exonuclease protection. Replacing the 2'-OMe modification with, for instance, 2'F, and modifying the PS linkage can promote exonuclease protection while retaining metabolic stability.

Figure 19:
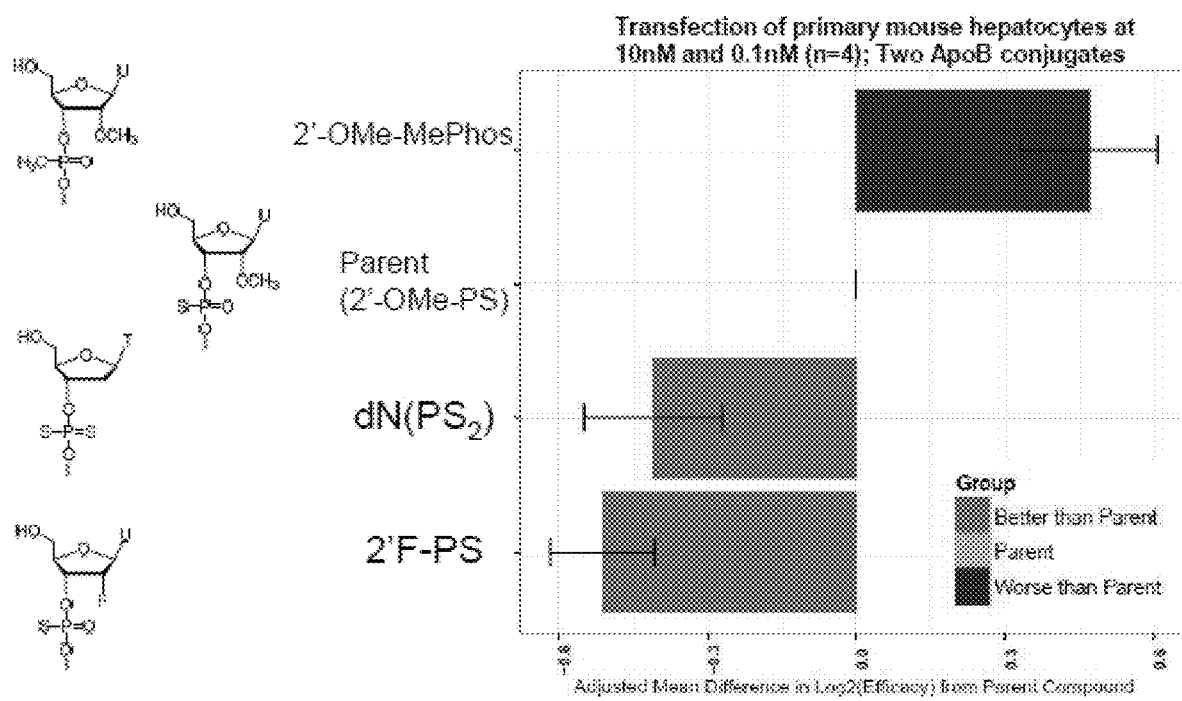
FIG. 19 shows a chart of an in vitro evaluation of end modifications, including 2'-OMe-MePhos, 2'-OMe-PS, dN($PS_2$), and 2'F-PS. Transfection of primary mouse hepatocytes at 10 nM and 0.1 nM (n=4) were carried out on two ApoB conjugates.

FIG. 19 shows a chart of an in vitro evaluation of end modifications, including 2'-OMe-MePhos, 2'-OMe-PS, dN(PS$_2$), and 2'F-PS. As shown in the chart, the dn(PS$_2$) linkage and 2'F-PS showed improved in vitro activity relative to the parent (2'OMe-PS). In particular, the dN(PS)2 was stable in the in vitro tritosome assay, while the 2'F-PS showed metabolic liability. Transfections of primary mouse hepatocytes at 10 nM and 0.1 nM (n=4) were carried out on two ApoB conjugates.

Figure 20:
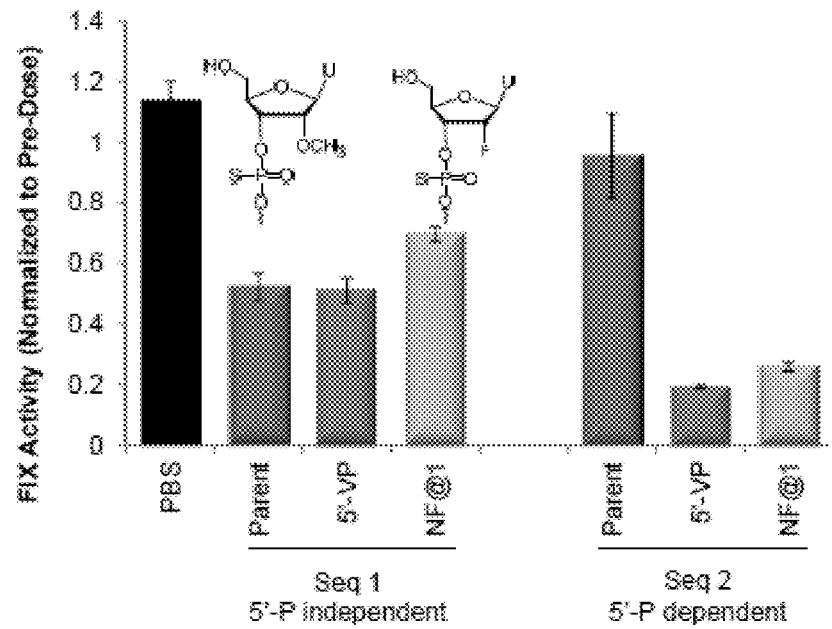
FIG. 20 shows two charts showing how a minor change at the antisense 5'-end can significantly improve in vivo efficacy. The chart on the left, A), shows that 2'F-PS at position 1 of the antisense strand can improve activity of 5'P-dependent sequences (with a single 3 mg/kg SC dose, and F9 activity was measured at day 3). The chart on the right, B), shows a ~3-fold improved potency by dN($PS)_2$ over the parent, similar to VP (with a single 10 mg/kg SC dose, and LDL was measured at day 3 for ApoB).
Figure 20:
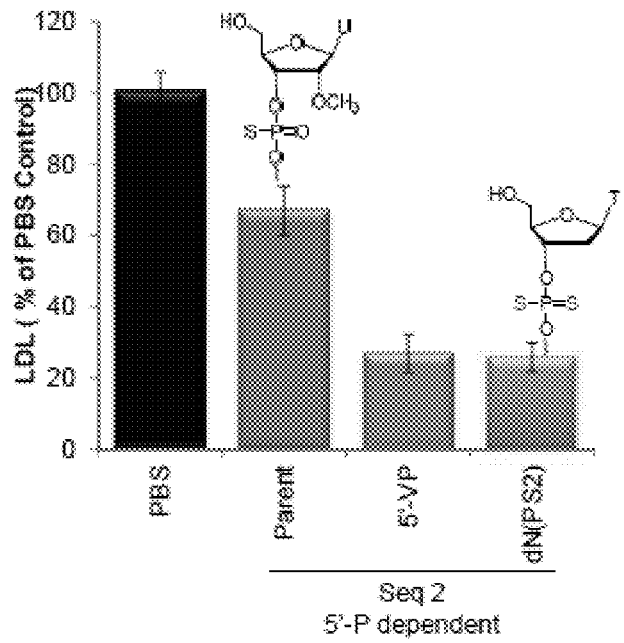

FIG. 20 shows two charts showing how a minor change at the antisense 5'-end can significantly improve in vivo efficacy. FIG. 20A shows that 2'F-PS at position 1 of the antisense strand can improve activity of 5'P-dependent sequences, and FIG. 20B shows a ~3-fold improved potency by dN(PS)$_2$ over the parent, similar to 5'-VP.

Example 6: 5'-VP Modifications and Evaluation on siRNA Activity

Synthesis of 5' Vinylphosphonate Phosphoramidite with Pivaloxymethyl Protecting Group:

Scheme 1

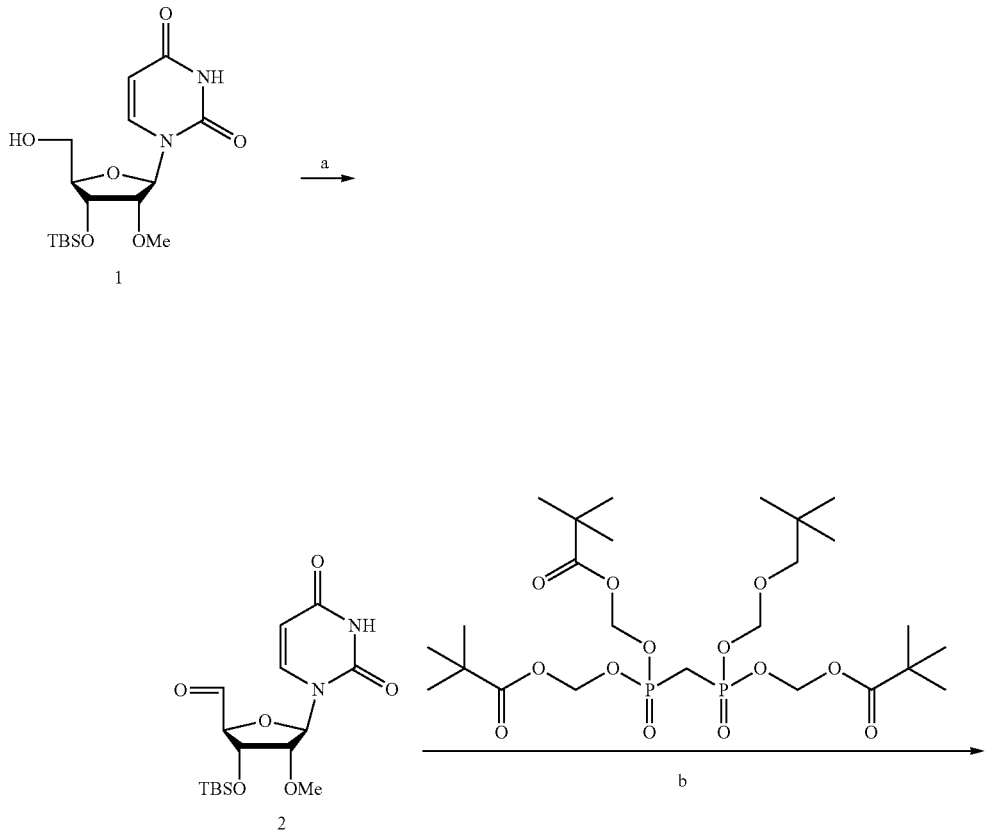

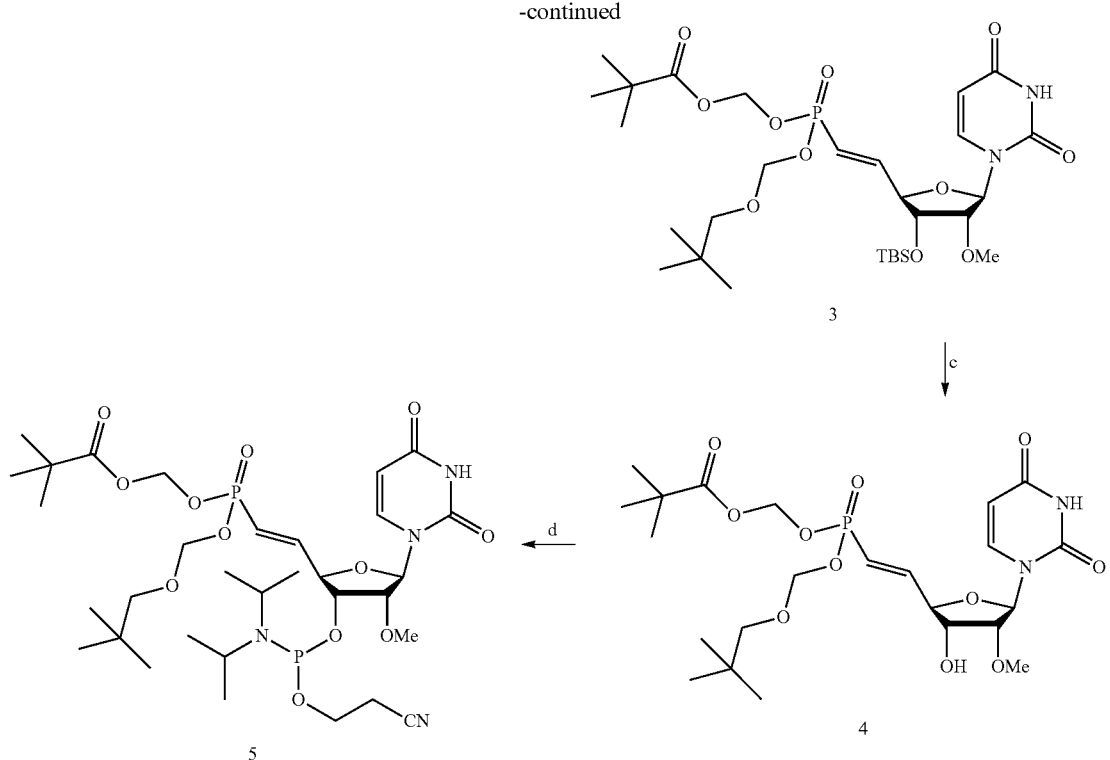

Reagents and reaction conditions for Scheme 1: (a) Dess-Martin periodinane, DCM, 0° C.; (b) NaH, tetra(pivaloyloxymethyl) bisphosphonate, THF, −78° C., followed by stirring at 0° C., 70% (E and Z isomers); (c) formic acid: water, 1:1, 24 hours, separated E and Z isomers by silica column chromatography or by RP-HPLC (reversed phase HPLC); (d) 2-cyanoethyl N,N,N',N'-tetraisopropylphosphordiamidite, 5-(Ethylthio)-1H-tetrazole, ACN, 6 hours, room temperature, 65%.

Synthesis of Tetra(Pivaloyloxymethyl)-Bis-Phosphonate (X)

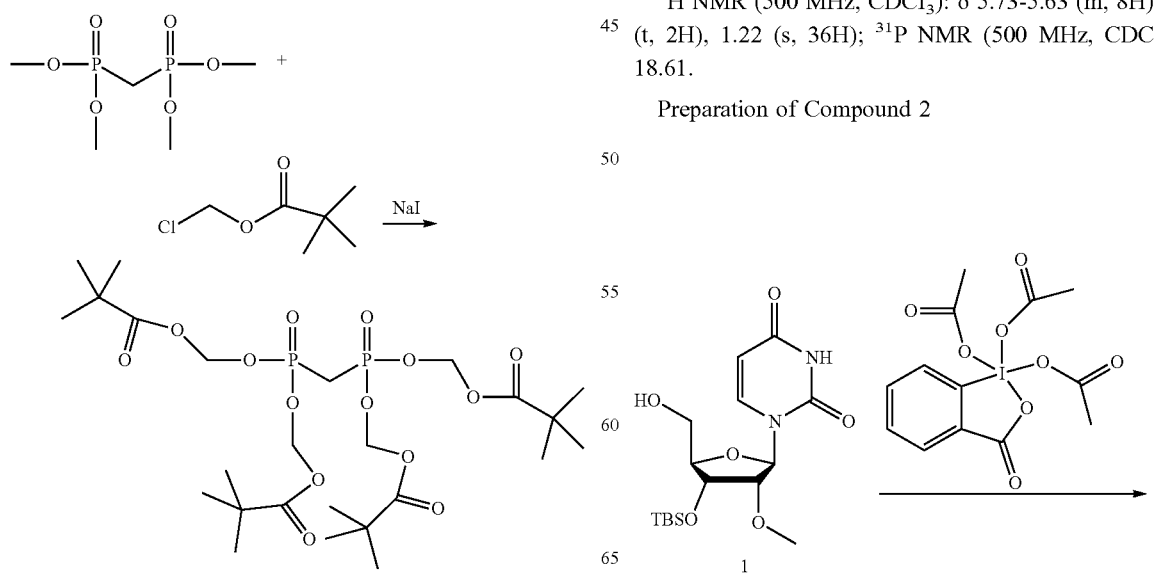

Tetramethyl methylenebisphosphonate (120 g, 0.51 mol), NaI (308 g, 2 mol), chloromethyl pivalate (387 g, 2.5 mol) and acetonitrile (400 ml) were mixed and refluxed overnight. TLC (thin-layer chromatography) in EtOAc with 5% methanol confirmed the formation of product. The reaction mixture was diluted with ether (1000 ml) and washed with water (2×1000 ml), dried with $Na_2SO_3$ and evaporated. The solid residue was washed with cold hexane and dried in vacuum to give 148 g (45%) of X as a pale yellow solid.

$^1$H NMR (500 MHz, $CDCl_3$): δ 5.73-5.63 (m, 8H), 2.65 (t, 2H), 1.22 (s, 36H); $^{31}$P NMR (500 MHz, $CDCl_3$): δ 18.61.

Preparation of Compound 2

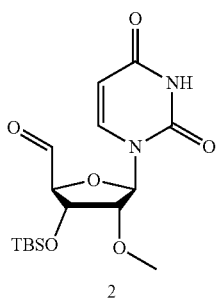

2

To an ice cold solution of compound 1 (3.0 g, 8 mmol) in 150 mL of anhydrous dichloromethane was added Dess-Martin periodinane (DMP) (1.4 equivalents; 4.7 g, 11.2 mmol). The reaction mixture was stirred at 0° C. for 1 hour and then at room temperature for 3 hours. TLC confirmed the formation of product. The reaction mixture was then added to 200 ml solution of 10% $Na_2S_2O_3$ and saturated $NaHCO_3$ (1:1), followed by addition of 200 ml ethyl acetate. The crude aldehyde was extracted in ethyl acetate dried and concentrated under reduced pressure. The crude aldehyde was used without any purification for next step.

Yield=2.87 gm (97%); purity by NMR approximately 70%; LC-MS: m/z 371.

Preparation of Compound 3

A solution of tetra polyoxometalate (POM)-bisphophonate sodium salt was prepared by addition of bisphosphonate (X) in 14 ml THF (12.6 gm, 20 mmol) to a suspension of NaH (0.58 g, 24 mmol) in 20 mL of THF at −78° C. and stirred for 15 minutes.

A solution of the aldehyde 2 (2.86 g) in 40 mL of anhydrous THF was added dropwise, to the above-prepared tetra (POM) bisphosphonate sodium salt solution at −78° C. The reaction mixture was stirred at −78° C. for 1 hour, 0° C. for the next hour and then at room temperature for one hour. TLC confirmed the formation of product (EtOAc: hexane 7:3). The crude reaction mixture was added to 300 ml saturated ammonium chloride and extracted with 300 ml ethyl acetate. The organic layer was washed with brine, dried over sodium sulphate. The solution was then concentrated under reduced pressure and the residue was purified by silica gel column chromatography (EtOAc in hexane=20-100%) to give compound 3 (4.0 g) as a mixture of E/Z isomers (88/12) in 72% yield.

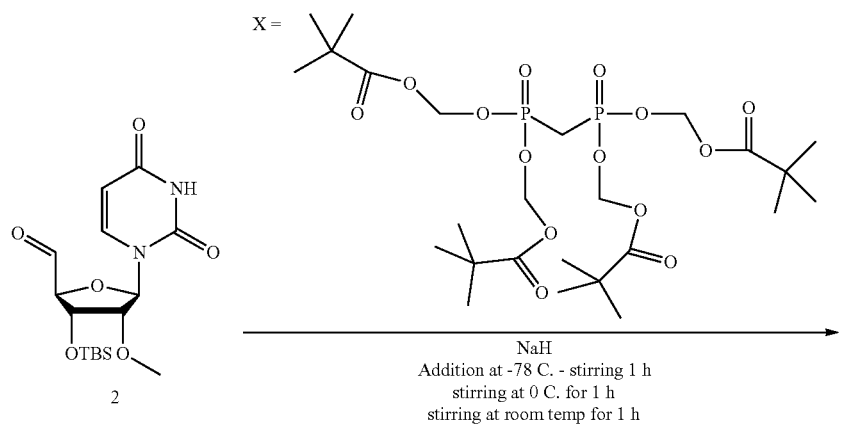

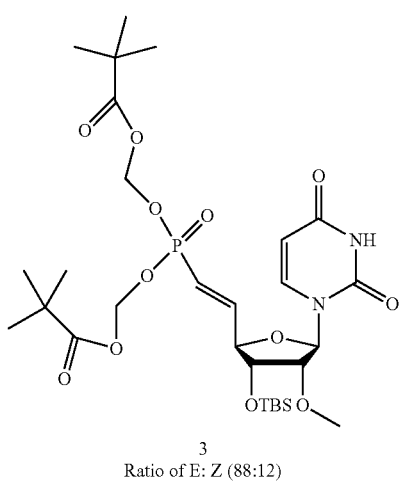

3
Ratio of E: Z (88:12)

Preparation of Compound 4

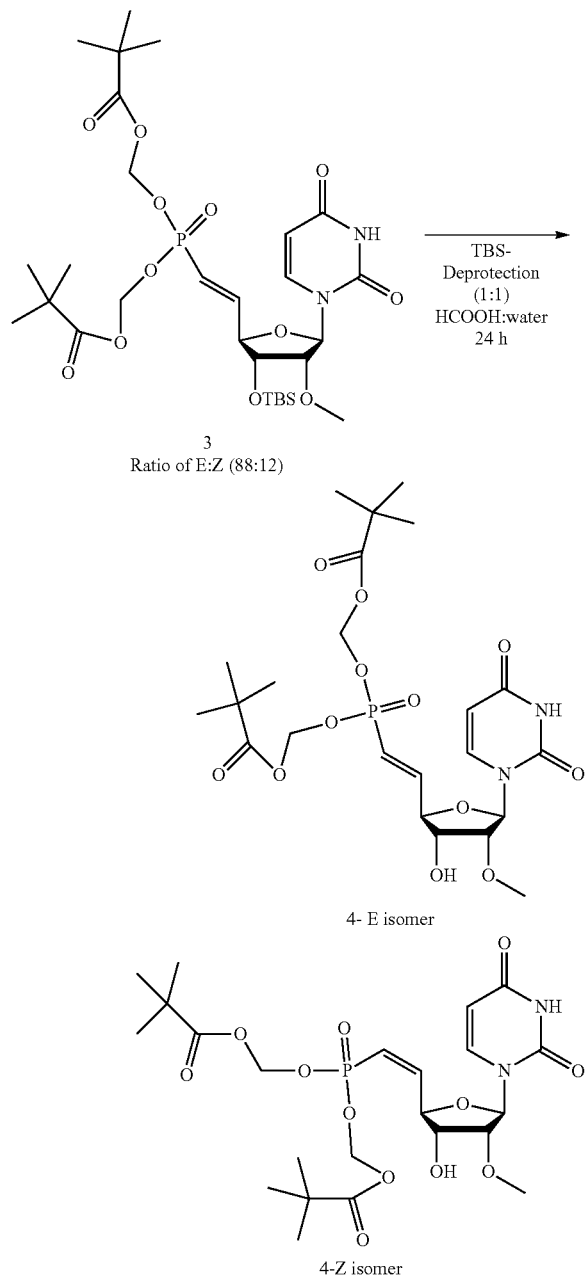

A solution of 3 (4 g, 5.7 mmol) in 200 mL of HCOOH/H$_2$O (1:1, v:v) was stirred at room temperature for 24 hours. TLC confirmed the formation of product (MeOH: CH$_2$Cl$_2$=5:95).

The solution was concentrated under reduced pressure and the residue was purified by silica gel column chromatography (MeOH: CH$_2$Cl$_2$ =7:93 v/v). Fractions were tested on RP-HPLC (C18 column, buffer A=0.05% TFA in water, buffer B=0.05% TFA in ACN; gradient 5-95% over 25 minutes) to confirm the purity of two isomers (E and Z isomers): E isomer elutes at 14.1 minutes and Z isomer elutes at 14.9 minutes. Initial fractions from silica gel chromatography contained mixture of E and Z isomers, and the rest of the fractions were E isomer. The fractions containing mixture of E and Z isomers were purified on RP-HPLC. Obtained 4-E isomer 2.3 g, 71% yield.

E Isomer:
$^1$H NMR (400 MHz, Acetonitrile-d$_3$): δ 8.98 (s, 1H), 7.30 (d, J=8.1 Hz, 1H), 6.80 (ddd, J=23.7, 17.2, 5.0 Hz, 1H), 6.02 (ddd, J=21.6, 17.1, 1.7 Hz, 1H), 5.77 (d, J=3.2 Hz, 1H), 5.57 (m, 5H), 4.32 (m, 1H), 4.01 (dd, J=7.0, 5.4 Hz, 1H), 3.82 (dd, J=5.5, 3.2 Hz, 1H), 3.41 (s, 3H), 1.14 (d, J=1.5 Hz, 18H); $^{31}$P NMR (162 MHz, Acetonitrile-d$_3$): δ 18.29.

Z Isomer:
$^1$H NMR (500 MHz, Acetonitrile-d$_3$): δ 9.50 (s, 1H), 7.44 (d, J=8.1 Hz, 1H), 6.69 (ddd, J=54.4, 13.3, 8.7 Hz, 1H), 5.93 (ddd, J=17.8, 13.3, 1.3 Hz, 1H), 5.80 (d, J=2.9 Hz, 1H), 5.69-5.58 (m, 5H), 5.22 (m, 1H), 4.01 (dd, J=7.1, 5.3 Hz, 1H), 3.88 (dd, J=5.3, 2.9 Hz, 1H), 3.49 (s, 3H), 1.19 (d, J=5.8 Hz, 18H); $^{31}$P NMR (202 MHz, Acetonitrile-d$_3$): δ 18.75.

Preparation of Compound 5

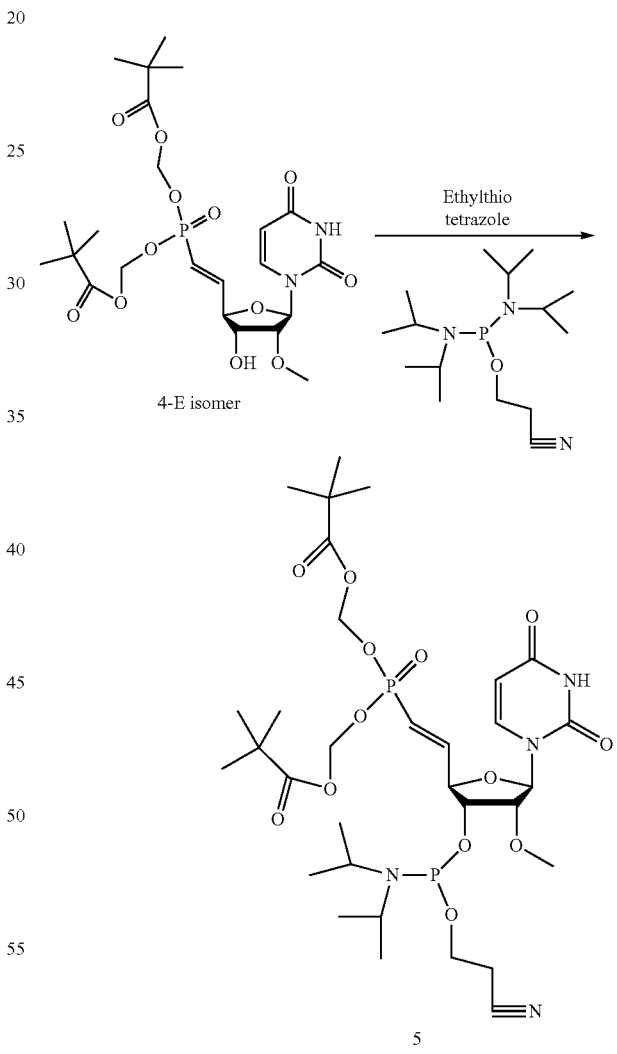

To a solution of compound 4-E isomer (2.1 g, 3.62 mmol) and ethylthio tetrazole (0.46 g, 3.62 mmol) in ACN (40 mL) was added 2-cyanoethyl N,N,N', N'-tetraisopropylphosphordiamidite (1.311 g, 4.35 mmol). The mixture was stirred at room temperature for 2 hours. TLC in Hexane: EtOAc (2:8 in 0.15% TEA) confirmed the formation of product. The reaction mixture was filtered, concentrated, and loaded onto a silica column. The sample was eluted with 20% to 100% EtOAc in hexane with TEA (0.15%) to afford compound 5 as white foam (1.75 g, 62%).

E Isomer:

$^1$H NMR (400 MHz, Acetonitrile-d$_3$): δ 9.09 (s, 1H), 7.38 (d, J=8.1 Hz, 1H), 6.89 (m, 1H), 6.10 (dddd, J=21.4, 17.1, 2.8, 1.7 Hz, 1H), 5.86 (t, J=3.8 Hz, 1H), 5.67 -5.55 (m, 5H), 4.66-4.50 (m, 1H), 4.40-4.20 (m, 1H), 3.99 (m, 1H), 3.92-3.57 (m, 4H), 3.44 (s, 3H), 2.73 -2.64 (m, 2H), 2.14 (s, 1H), 1.24-1.14 (m, 30H); $^{31}$P NMR (162 MHz, Acetonitrile-d$_3$): δ 151.79 (d, J=71.3 Hz), 18.07 (d, J=54.0 Hz).

Z Isomer:

$^1$H NMR (400 MHz, Acetonitrile-d$_3$): δ 9.02 (s, 1H), 7.41 (dd, J=8.1, 1.6 Hz, 1H), 6.62 (dddd, J=53.7, 13.1, 9.7, 7.0 Hz, 1H), 5.97 (dd, J=17.4, 13.1 Hz, 1H), 5.80 (dd, J=7.0, 3.5 Hz, 1H), 5.70-5.52 (m, 5H), 5.41 (m, 1H), 4.40-4.10 (m, 1H), 4.06-3.98 (m, 1H), 3.93 -3.56 (m, 4H), 3.47 (s, 3H), 2.68 (m, 2H), 2.14 (s, 1H), 1.33-1.11 (m, 30H); $^{31}$P NMR (202 MHz, Acetonitrile-d$_3$): δ 150.81 (d, J=141.4 Hz), 15.17.

Protocols for Synthesis of Oligonucleotides Containing 5'-Vinyl Phosphonate

The vinylphosphonate monomers and 5'-VP modified oligonucleotide synthesis were done similar to the procedures in the literature (WO 2008/100447 to Chen et al.; Lima et al. "Single-Stranded siRNAs Activate RNAi in Animals," Cell 150: 883-894 (2012); Prakash et al., "Identification of metabolically stable 5-phosphate analogs that support single-stranded siRNA activity," Nucleic Acids Research 43: 2993-3011 (2015), which are hereby incorporated by reference in their entirety). Briefly, the 5'-phosphate is protected by ethyl ether, and then, the ethyl ether-protected phosphate goes through two-step deprotection: 1) TMS-I on solid support under anhydrous condition and 2) a standard oligonucleotide deprotection to obtain a 5'-VP modified oligonucleotide. This process is also discussed in Example 5.

Effect of Metabolically Stable (E-) and (Z-) 5'-Vinylphosphonate on siRNA Activity Double-stranded small interfering RNA (siRNA) with 5'-phosphorylated antisense strand facilitates efficient loading onto RNA-induced silencing complex (RISC) to elicit robust RNAi mediated gene silencing. Endogenous 5'-phosphorylation by Clp1 kinase of synthetic siRNAs is, therefore, critical for RISC loading and strand selection (Weitzer et al., "The human RNA kinase hC1p1 is active on 3' transfer RNA exons and short interfering RNAs," Nature 447: 222-226 (2007)). Phosphate mimics with metabolically stable linkage have been used for nucleoside modifications as antivirals (WO 2008/100447 to Chen et al.), for 5'-end modification of siRNAs to improve gene silencing activity over the corresponding non-phosphorylated siRNAs, in particular single stranded siRNA (Lima et al. "Single-Stranded siRNAs Activate RNAi in Animals," Cell 150: 883-894 (2012); Prakash et al., "Identification of metabolically stable 5-phosphate analogs that support single-stranded siRNA activity," Nucleic Acids Research 43: 2993-3011 (2015)).

In this example, the effect of phosphate mimics in double stranded siRNAs were evaluated both in vitro and in vivo.

The siRNA sequences used in this example are shown in the tables below. The table discloses SEQ ID NOS 207-214, respectively, in order of columns.

| Duplex ID | Sense Sequence | Antisense Sequence |
|---|---|---|
| AD-66572 | usgsgaagCfaGfUf AfuguugauggaL96 | usCfscauCfaAfCfauac UfgCfuuccasasa |
| AD-68365.3 | usgsgaagCfaGfUf AfuguugauggaL96 | VPuCfcauCfaAfCfauac UfgCfuuccasasa |
| AD-68431.1 | usgsgaagCfaGfUf AfuguugauggaL96 | VPUfCfcauCfaAfCfaua cUfgCfuuccasasa |
| AD-68433.1 | usgsgaagCfaGfUf AfuguugauggaL96 | VP(Tam)CfcauCfaAfCf auacUfgCfuuccasasa | u = 2'OMe, 5' OH U
Vpu = 2'OMe, 5'VP U
VPUf = 2'F, 5'VP U
VP(Tam) = 2'N-methylacetamide, 5'VP T

| Modification at N1 of antisense | % knockdown of Factor IX @ 1 mg/kg (day 14) |
|---|---|
| 2'OMe, 5' OH U | 46 |
| 2'OMe, 5'VP U | 80 |
| 2'F, 5'VP U | 83 |
| 2'N-methylacetamide, 5'VP T | 77 |

The impact of 5'-vinylphosphonate (VP) with E- and Z-geometry on double stranded siRNA activity were compared. The results show that in vivo efficacy for chemically modified siRNAs can be improved with 5'-trans-(E-)VP that mimics natural phosphate well, whereas, 5'-cis-(Z-)VP did not show improvement in efficacy, suggesting that the Z-isomer does not mimic the natural phosphate well.

Figure 21:
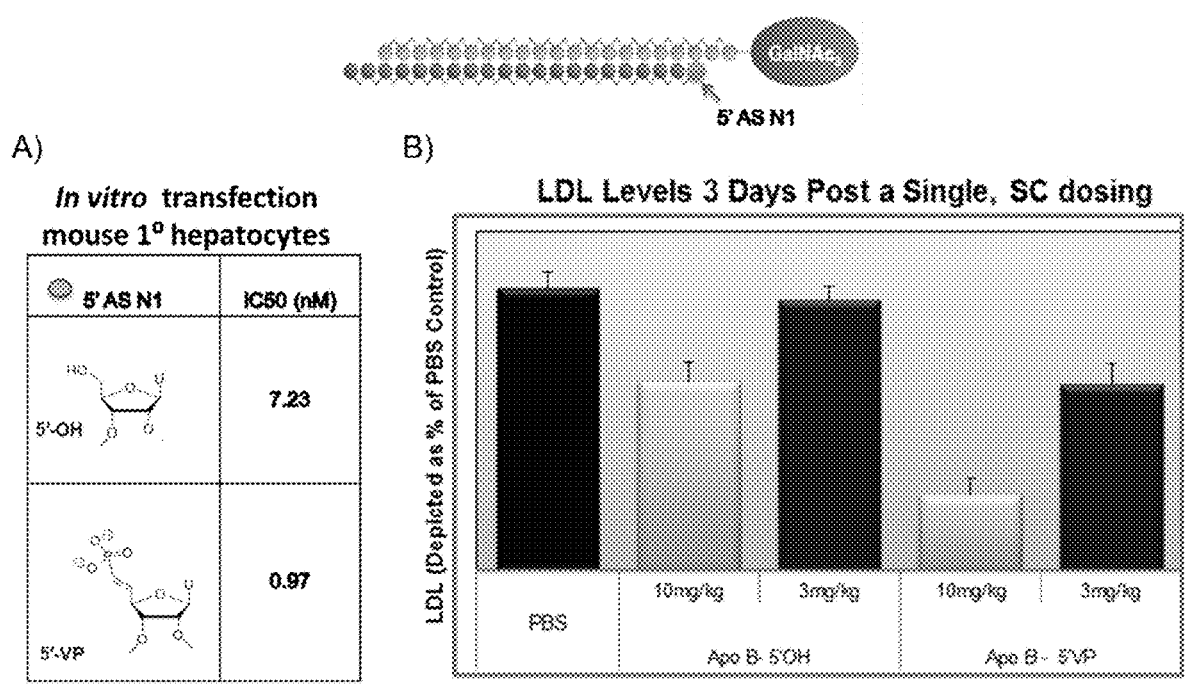
FIG. 21 shows the SAR analysis of in vitro and in vivo activity of ApoB siRNAs containing 5'-OH versus 5'-E-VP modification (at the 5-end of the antisense strand). A) shows the results with in vitro transfection mouse 1° hepatocytes. B) shows the LDL levels 3 days post a single dosing (SC dosing).

FIGS. 21A-B show the SAR analysis of in vitro and in vivo activity of ApoB siRNAs containing 5'-OH versus 5'-E-VP modification (at the 5'-end of the antisense strand). FIG. 21A shows the results with in vitro transfection mouse 1° hepatocytes. FIG. 21B shows the LDL levels 3 days post a single dosing (SC dosing). The results of FIG. 21B demonstrate that ApoB siRNAs that were modified with 5'-E-VP showed improved activity.

Figure 22:
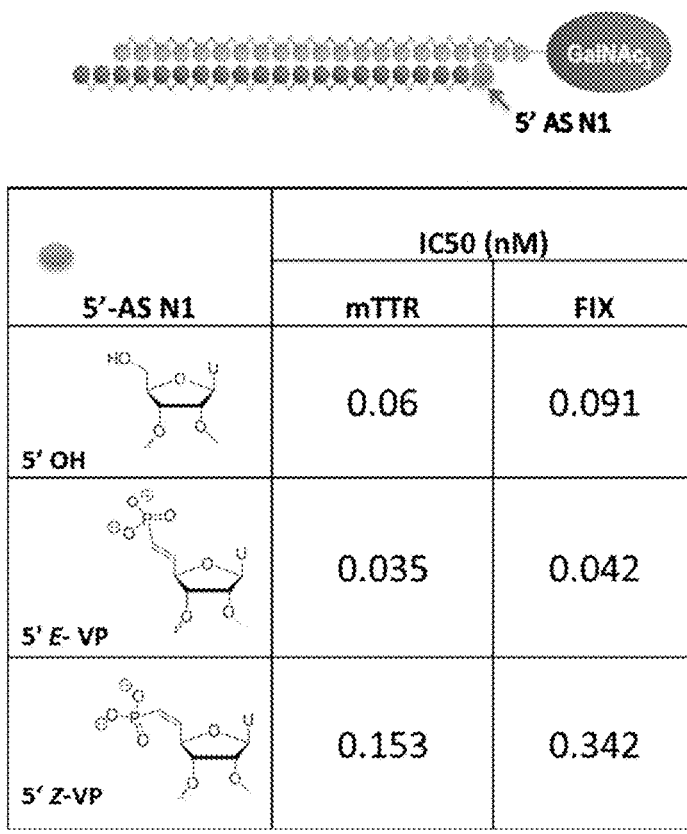
FIG. 22 shows the results of in vitro potency of 5'-E-VP modification versus 5'-Z-VP modification to mTTR and F9 siRNA-GalNAc conjugates. The results were from in vitro transfection mouse primary hepatocytes.

FIG. 22 shows the results of in vitro potency of 5'-E-VP modification versus 5'-Z-VP modification to mTTR and F9 siRNA-GalNAc conjugates. The results were from in vitro transfection mouse primary hepatocytes. As shown in the figure, the siRNA conjugate that was modified with 5'-E-VP showed retained or improved potency, whereas the siRNA conjugate that was modified with 5'-Z-VP showed decreased potency.

Figure 23:
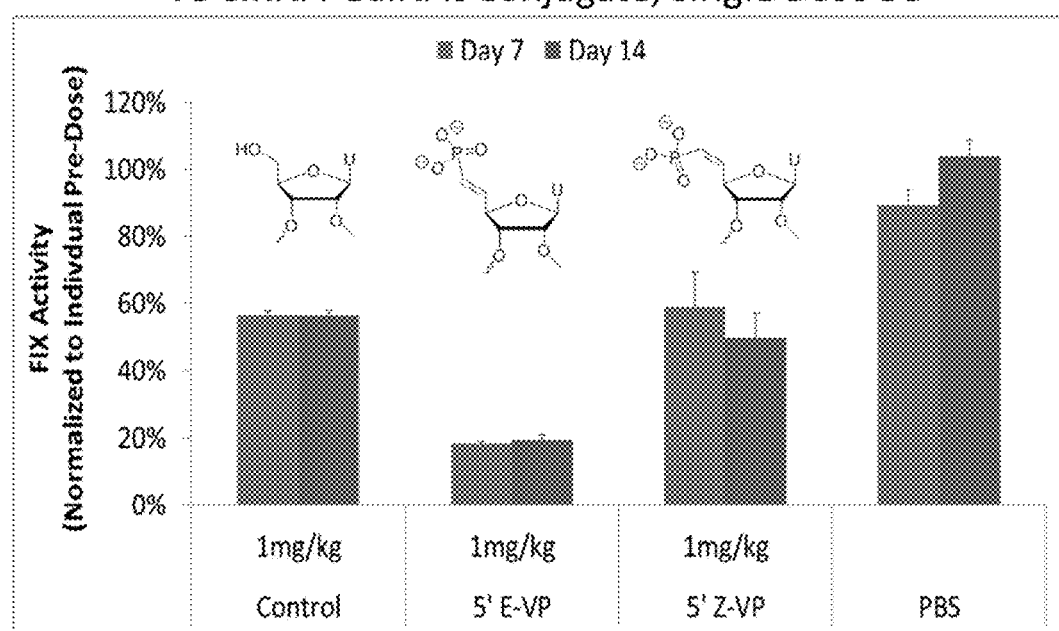
FIG. 23 shows the results of in vivo comparison of 5'-E-VP modification versus 5'-Z-VP modification to F9 siRNA-GalNAc conjugate (single SC dosing).

FIG. 23 shows the results of in vivo comparison of 5'-E-VP modification versus 5'-Z-VP modification to F9 siRNA-GalNAc conjugate (single SC dosing). The results demonstrate that the siRNA conjugate that was modified with 5'-E-VP showed improved gene silencing activity over the 5'-OH control, whereas the siRNA conjugate that was modified with 5'-Z-VP showed a similar activity to that of the 5'-OH control.

The results of these figures show that 5'-phosphorylation of antisense strand is desirable for efficient RNAi mediated gene silencing. The efficacy of chemically modified siRNAs can be improved with 5'-trans-vinylphosphonate (5'-E-VP) which mimics natural phosphate well.

Example 7: 5'-C-Malonyl Modifications and Evaluation on siRNA Activity

Synthesis and Incorporation of 5'—C-Malonyl Nucleotides to the 5'-End of siRNA:

General experimental conditions: All moisture-sensitive reactions were carried under anhydrous conditions under argon atmosphere. Flash chromatography was performed on a Teledyne ISCO (Lincoln, NE) Combi Flash system using pre-packed ReadySep Teledyne ISCO silica gel columns. Electrospray ionization—high resolution mass spectrometry (ESI-HRMS) spectra were recorded on Waters (Milford, MA) Q-Tof API-US spectrometer using the direct flow injection in the positive mode (capillary =3000 kV, cone=35, source temperature=120° C., and desolvation temperature=350° C.). $^1$H and $^{13}$C NMR spectra were recorded at room temperature on Varian spectrometers (Palo Alto, CA) at 400 MHz ($^1$H) and 126 MHz ($^{13}$C), and chemical shifts in ppm were referenced to the residual solvent peaks. Coupling constants were given in Hertz. Signal splitting patterns were described as singlet (s), doublet (d), triplet (t), quartet (q), broad signal (br), or multiplet (m). $^{31}$P NMR spectra were recorded at 162 MHz under proton-decoupled mode, and chemical shifts were referenced to external H3PO4 (80%). LC/ESI-MS was performed on an Agilent (Santa Clara, CA) 6130 single quadrupole LC/MS system using an XBridge $C_8$ column (2.1×50 mm, 2.5 µm) at 60° C. Buffer A consisted of 100 mM 1,1,1,3,3,3-hexafluoro-2-propanol (HFIP) and 16.3 mM triethylamine (TEA) in $H_2O$, and buffer B was 100% methanol.

Scheme 2

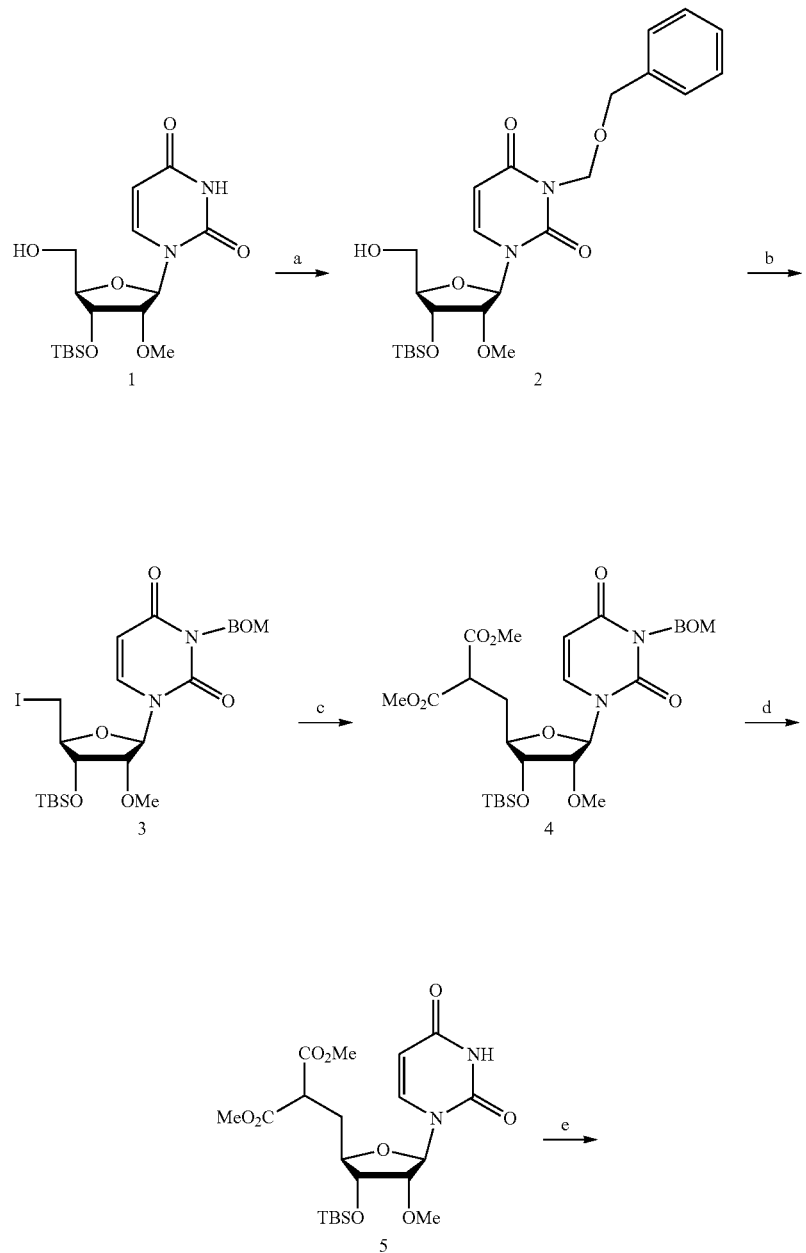

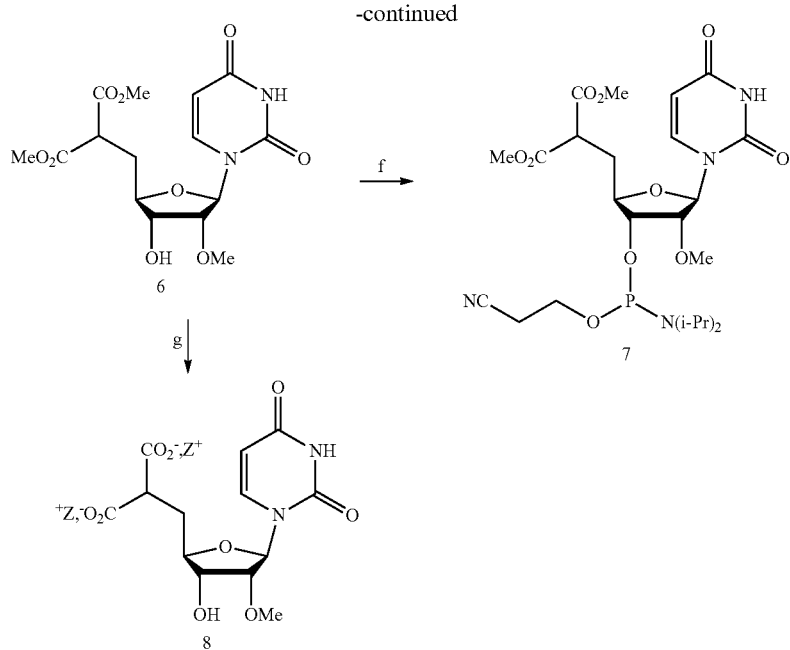

Reagents and conditions for Scheme 2: (a) benzyloxymethyl acetal (BOM) chloride, DBU, DMF, 30 minutes, 0° C., quantitative (Kurosu et al., "Synthetic studies towards the identification of novel capuramycin analogs with mycobactericidal activity," Heterocycles 77: 217-225 (2009); Kurosu et al., "Concise Synthesis of Capuramycin," Org. Lett. 11:2393-2396 (2009), which are incorporated by reference in their entirety); (b) methyltriphenoxyphosphonium iodide, DMF, 15 minutes, romm temperature, 92%; (c) sodium methoxide, dimethyl malonate, 1,2-DME, 24 hours, reflux, 92%; (d) 10% Pd/C, $H_2$ atm, i-PrOH/$H_2$O (10:1, v/v), 0.05 equivalents formic acid, 12 hours, room temperature, 98% (Aleiwi et al., "A reliable Pd-mediated hydrogenolytic deprotection of BOM group of uridine ureido nitrogen," Tetrahedron Lett. 53: 3758-3762 (2012), which is incorporated by reference in its entirety); (e) $NEt_3$-3HF, THF, 48 hours, room temperature, 88%; (d) 2-cyanoethyl N,N-diisopropylchlorophosphoramidite, DIEA, DCM, 18 hours, room temperature, 56%; (g) 1 M aqueous piperidine, 24 hours, room temperature; then 30% aqueous ammonia/ethanol (3:1, v/v), 36 hours, room temperature, quantitative, $Z^+$=piperidinium.

Synthesis of $N^3$-Benzyloxymethyl-2'-O-Methyl-3'-O-Tert-Butyldimethylsilyluridine (2)

2'-O-Methyl-3'-O-tert-butyldimethylsilyl-uridine (1, 20 g, 53.7 mmol) was transformed in 2 (26.5 g, quantitative) following a variant of a previously reported procedure.

Synthesis of $N^3$-Benzyloxymethyl-5'-Deoxy-5'-Iodo-2'-O-Methyl-3'-O-Tert-Butyldimethylsilyluridine (3)

Compound 2 (10 g, 20.3 mmol) was dissolved in 100 mL of anhydrous DMF, and 20 g (40.6 mmol) of methyltriphenoxyphosphonium iodide were added. The mixture was stirred at room temperature for 15 minutes. Methanol (200 mL) was added to the reaction, and the mixture was stirred for additional 15 minutes. The solvents were evaporated to dryness; the residue was dissolved in dichloromethane (DCM) and washed with a 5% solution of $Na_2S_2O_3$ followed by water washing. The organic layers were collected, dried over $Na_2SO_4$, filtered, and evaporated to dryness. The crude residue was purified by silica gel chromatography, using 0-50% ethyl acetate (EtOAc) in hexanes as eluent to obtain 3 as white foam (11.2 g, 92%).

$^1$H NMR (400 MHz, DMSO-$d_6$): δ 7.77 (d, J=8.2 Hz, 1H), 7.30 (m, 5H), 5.90 (d, J=5.2 Hz, 1H), 5.85 (d, J=8.2 Hz, 1H), 5.33 (d, J=13.0 Hz, 1H), 5.30 (d, J=13.0 Hz, 1H), 4.58 (s, 2H), 4.23 (t, J=4.5 Hz, 1H), 4.07 (t, J=5.1 Hz, 1H), 3.87 (q, J=6.1 Hz, 1H), 3.55 (dd, J=10.6, 6.3 Hz, 1H), 3.39 (dd, J=10.6, 6.3 Hz, 1H), 3.32 (s, 3H), 0.89 (s, 9H), 0.14 (s, 3H), 0.12 (s, 3H). $^{13}$C NMR (126 MHz, DMSO-$d_6$): δ 161.7, 150.7, 140.2, 138.0, 128.2, 127.4, 127.3, 101.6, 87.9, 83.3, 80.8, 72.7, 71.0, 70.1, 57.6, 25.6, 17.7, 6.2, −4.7, −4.8.

HRMS-ESI: calculated for $C_{24}H_{35}IN_2NaO_6Si$ (M+Na)$^+$ is 625.1207; found: 625.1205.

Synthesis of $N^3$-Benzyloxymethyl-5'-Deoxy-5'-C-(dimethylmalonyl)-2'-O-methyl-3'-O-tert-butyldimethylsilyluridine (4)

Sodium methoxide (2 g, 33 mmol) was placed in a dry round-bottom flask, dimethyl malonate (12 mL, 100 mmol) and anhydrous 1,2-dimethoxyethane (DME, 100 mL) were added, and the mixture was brought to reflux. Compound 3 (10 g, 16.5 mmol), after being co-evaporated twice with anhydrous acetonitrile, was dissolved in 70 mL of anhydrous DME and added to the refluxing solution of dimethyl malonate and sodium methoxide. Reflux was continued for 24 hours. The reaction mixture was cooled to room temperature, and methanol (50 mL) was added to quench the reaction. Solvents and volatiles were evaporated in vacuo. The crude residue was purified by silica gel chromatography, using 0-100% EtOAc in hexanes as eluent to obtain compound 4 as colorless oil (9.2 g, 92%).

$^1$H NMR (400 MHz, DMSO-$d_6$): δ 7.66 (d, J=8.2 Hz, 1H), 7.30 (m, 5H), 5.80 (d, J=8.2 Hz, 1H), 5.76 (d, J=4.0 Hz, 1H), 5.33 (d, J=13.4 Hz, 1H), 5.30 (d, J=13.4 Hz, 1H), 4.58 (s, 2H), 4.14 (t, J=5.4 Hz, 1H), 3.91 (m, 1H), 3.76 (m, 1H), 3.64 (m, 4H), 3.60 (s, 3H), 3.33 (s, 3H), 2.37—2.09 (m, 2H), 0.87 (s, 9H), 0.09 (s, 3H), 0.08 (s, 3H). $^{13}$C NMR (126 MHz, DMSO-d6): δ169.1, 168.8, 161.9, 150.6, 140.4, 138.0, 128.1, 127.4, 127.3, 101.3, 88.6, 88.5, 81.3, 80.9, 73.1, 71.0, 70.0, 59.7, 57.5, 52.5, 48.0, 31.5, 25.6, 17.7, -4.76, -5.06.

HRMS-ESI: calculated for $C_{29}H_{42}N_2NaO_{10}Si$ (M+Na)$^+$ is 629.2506; found: 629.2508.

Synthesis of 5'-Deoxy-5'—C-(Dimethylmalonyl)-2'-O-Methyl-3'-O-Tert-butyldimethylsilyluridine (5)

Compound 4 (8.7 g, 14.3 mmol) was dissolved in 660 mL of iso-propanol/water (10:1, v/v), and 0.9 g of 10% Pd/C was added, followed by 27 mL (0.7 mmol) of formic acid. The air from the flask was removed under vacuum; the reaction flask was flushed with hydrogen and was stirred under hydrogen atmosphere at normal pressure at room temperature for 12 hours. The reaction mixture was filtered through celite and rinsed with ethanol. The filtrates were collected and evaporated to dryness. The crude residue was purified by silica gel chromatography, using 0-5% MeOH in DCM as eluent. The appropriate fractions were pooled and evaporated to dryness to obtain 5 as white foam (6.7 g, 98%).

$^1$H NMR (400 MHz, DMSO-d$_6$): δ11.38 (d, J=1.8 Hz, 1H), 7.61 (d, J=8.1 Hz, 1H), 5.71 (d, J=4.3 Hz, 1H), 5.65 (dd, J=8.0 Hz, J=2.1 Hz, 1H), 4.16 (t, J=5.3 Hz, 1H), 3.91 (t, J=4.8 Hz, 1H), 3.73 (m, 1H), 3.63 (m, 4H), 3.61 (s, 3H), 3.31 (s, 3H), 2.24—2.07 (m, 2H), 0.87 (s, 9H), 0.08 (s, 3H), 0.08 (s, 3H). $^{13}$C NMR (126 MHz, DMSO-d$_6$): δ 169.2, 168.9, 163.0, 150.4, 141.2, 141.2, 102.1, 87.7, 81.2, 80.9, 73.1, 57.5, 52.5, 52.4, 52.3, 48.0, 31.6, 25.6, 17.7, -4.8, -5.1.

HRMS-ESI: calculated for $C_{21}H_{34}N_2NaO_9Si$ (M+Na)$^+$ is 509.1931; found: 509.1929.

Synthesis of 5'-Deoxy-5'-C-(Dimethylmalonyl)-2'-O-Methyluridine (6)

Compound 5 (6.7 g, 13.8 mmol) was stirred with triethylamine-trihydrofluoride (11 mL, 202.5 mmol) in 150 mL of anhydrous THF in a round-bottom flask at room temperature for 48 hours. The solvents were evaporated in vacuo to two-thirds the original volume. The residue was purified by silica gel chromatography, using 0-10% MeOH in DCM as eluent. The appropriate fractions were pooled and evaporated to dryness to obtain 6 as white foam (4.5 g, 88%).

$^1$H NMR (400 MHz, DMSO-d$_6$): δ 11.37 (s, 1H), 7.56 (d, J=8.1 Hz, 1H), 5.72 (d, J=4.3 Hz, 1H), 5.64 (d, J=8.1 Hz, 1H), 5.24 (d, J=6.3 Hz, 1H), 3.94 (q, J=5.7 Hz, 1H), 3.86 (t, J=4.8 Hz, 1H), 3.72 (m, 1H), 3.64 (m, 4H), 3.61 (m, 3H), 3.34 (s, 3H), 2.25-2.07 (m, 2H). $^{13}$C NMR (126 MHz, DMSO-d$_6$): δ 169.2, 169.0, 163.0, 150.3, 141.0, 102.0, 87.4, 81.6, 80.8, 71.9, 57.6, 52.5, 52.4, 48.0, 31.9.

HRMS-ESI: calculated for $C_{15}H_{20}N_2NaO_9$ (M+Na)$^+$ is 395.1067; found: 395.1070.

Synthesis of 5'-Deoxy-5'—C-(Dimethylmalonyl)-2'-O-Methyluridine-3'-O—(O-(2-cyanoethyl)-N,N-di-isopropyl)phosphoramidite (7)

Compound 6 (3.0 g, 8 mmol) was co-evaporated three times with anhydrous acetonitrile and then dried overnight under vacuum over P$_2$O$_5$. The dry residue was dissolved in 60 mL of anhydrous DCM; diisopropylethylamine (4.5 mL, 24 mmol) and 2-cyanoethyl N,N-diisopropylchlorophosphoramidite (2.2 mL, 10.0 mmol) were added successively. After 1 hour of stirring under argon atmosphere, another 1.0 mL (4.0 mmol) of 2-cyanoethyl N,N-diisopropylchlorophosphoramidite was added, and the stirring continued for additional 18 hours. The reaction mixture was diluted with 150 mL of DCM and washed with 200 mL of saturated sodium bicarbonate solution. The organic layer was dried with sodium sulfate and removed by filtration. The solvents were evaporated in vacuo, and the crude residue was purified by silica gel chromatography. The eluent was hexanes/EtOAc/NEt$_3$, (66:33:1, v/v/v in a step gradient to hexanes/EtOAc/NEt$_3$ 33:66:1, v/v/v). The appropriate fractions were pooled, evaporated to dryness, co-evaporated with anhydrous acetonitrile, and dried under high vacuum to obtain 7 as white foam (3.2 g, 56%).

$^1$H NMR (400 MHz, CD$_3$CN, mixture of diastereoisomers): δ 8.97 (s, 1H), 7.36 (m, 1H), 5.78 (d, J=4.2 Hz, 1H), 5.64 (d, J=8.1 Hz, 1H), 4.23-3.80 (m, 4H), 3.77-3.59 (m, 8H), 3.45 — 3.41 (m, 3H), 2.68 (t, J=5.9 Hz, 2H), 2.44-2.31 (m, 2H), 1.42-1.00 (m, 12H). $^{31}$P NMR (162 MHz, CD$_3$CN, mixture of diastereoisomers): δ 151.8, 151.6. $^{13}$C NMR (126 MHz, CD$_3$CN, mixture of diastereoisomers): δ 170.6, 170.2, 163.8, 151.3, 141.3, 119.6, 103.0, 102.9, 89.6, 89.2, 82.9, 82.5, 82.4, 81.8, 81.3, 81.2, 75.3, 75.2, 75.1, 75.0, 59.8, 59.7, 59.3, 59.1, 58.9, 58.8, 53.3, 53.2, 49.5, 49.4, 44.2, 44.15, 44.1, 44.0, 33.0, 25.0, 24.9, 24.8, 21.0, 20.9.

HRMS-ESI: calculated for $C_{24}H_{38}N_4O_{10}P$ (M+H)$^±$ is 573.2326; found: 573.2321.

Synthesis of 5'-Deoxy-5'—C-Malonyl-2'-O-Methyluridine, Piperidinium Salt (8)

Compound 6 (0.1 g, 0.3 mmol) was stirred with 1 M aqueous piperidine (10 mL, 10 mmol) at room temperature for 24 hours. The solvents were evaporated in vacuo, and the residue was dissolved in a mixture of 30% ammonia/ethanol (3:1, v/v) and stirred at room temperature for 36 hours. The solvents were evaporated in vacuo and 8 was obtained as colorless oil (quantitative).

$^1$H NMR (400 MHz, D$_2$O): δ 7.75 (d, J=8.1 Hz, 1H), 5.92 (m, 2H), 4.16 (t, J=5.5 Hz, 1H), 4.06 (t, J=4.7 Hz, 1H), 3.99 (m, 1H), 3.50 (s, 3H), 3.27 (t, J=7.0 Hz, 1H), 3.17 (t, J=5.7 Hz, 6H), 2.27-2.06 (m, 2H), 1.87-1.54 (m, 8H). $^{13}$C NMR (126 MHz, D$_2$O): δ 179.5, 179.2, 168.0, 153.0, 142.5, 103.1, 88.5, 83.7, 83.3, 72.7, 58.9, 55.9, 45.3, 34.7, 23.0, 22.2.

HRMS-ESI (M+H)$^+$: calculated for $C_{13}H_{17}N_2O_9$ is 345.0929; found: 345.0919.

Oligonucleotide Synthesis

Oligonucleotides were synthesized on an ABI-394 DNA/RNA synthesizer using modified synthesis cycles based on those provided with the instrument. A solution of 0.25 M 5-(S-ethylthio)-1H-tetrazole in acetonitrile was used as the activator. The phosphoramidite solutions were 0.15 M in anhydrous acetonitrile. The oxidizing reagent was 0.02 M I$_2$ in THF/pyridine/H$_2$O. N,N-Dimethyl-N'-(3-thioxo-3H-1,2,4-dithiazol-5-yl)methanimidamide (DDTT), 0.1 M in pyridine, was used as the sulfurizing reagent. The detritylation reagent was 3% dichloroacetic acid (DCA) in DCM. In the case of 5'-phosphate compounds, the Glen Research chemical phosphorylation reagent (Cat.# 10-1902-02) was used for the introduction of the 5'-monophosphate. After completion of the automated synthesis, the solid support was washed with 0.1 M piperidine in acetonitrile for 10 minutes, then washed with anhydrous acetonitrile and dried with argon. The oligonucleotide was then manually released from support and deprotected using a mixture of 30% NH$_4$OH/ethanol (3:1, v/v) or 40% methylamine (0.5 mL/μmol of solid support) for 6 hours at 55° C. or 15 minutes at 60° C., respectively. Solvent was collected by filtration and the support was rinsed with DMSO (1.5 mL/μmol of solid support).

The 5'—C-malonyl solid-supported oligonucleotides were first treated with 1 M aqueous piperidine (1.5 mL/μmol of solid support) for 24 hours at room temperature, and the solution was filtered off and evaporated to dryness. The residue was dissolved in a mixture of 30% NH$_4$OH/ethanol (3:1, v/v, 2 mL/μmol of solid support) and shaken at room temperature for 36 hours, then evaporated to dryness. Crude oligonucleotides were purified by anion-exchange HPLC using a linear gradient of 0.22 M to 0.42 M NaClO$_4$ in 0.02

M Tris-HCl, pH 8.5/50% (v) acetonitrile in 120-150 minutes at room temperature. All single strands were purified to >85% HPLC (260 nm) purity and then desalted by size exclusion chromatography using an AP-2 glass column (20×300 mm, Waters) custom-packed with Sephadex G25 (GE Healthcare), eluted with sterile nuclease-free water. Hybridization to generate siRNA duplexes was performed by mixing equimolar amounts of complementary strands to a final concentration of 20 µM in 1×PBS buffer, pH 7.4, and by heating in a water bath at 95° C. for 5 minutes followed by slow cooling to room temperature.

Evaluation of 5'—C-Malonyl Modifications on Gene Silencing Activity and Stability 5'-phosphorylation of double-stranded RNA is desirable for efficient loading of small interfering RNAs (siRNAs) into the RNA-induced silencing complex (RISC) resulting in RNAi-mediated gene silencing. Endogenous or exogenous siRNAs are generally readily phosphorylated by a cytosolic kinase, and, in most cases, the presence of a synthetic 5'-monophosphate is not required. However, in certain cases of chemically modified siRNAs, metabolically stable 5'-phosphate mimics can lead to higher stability, increased RISC loading and more potent gene silencing.

In this example, the effect of a 5'—C-malonyl moiety, which was incorporated as a modified nucleotide at the 5'-terminus of the antisense strand of chemically modified siRNAs using solid-phase synthesis, was evaluated. The 5'—C-malonyl can exist as a di-anion at physiological pH similar to the 5'-monophosphate di-anion. The in vitro gene silencing activity, metabolic stability and RISC loading of siRNAs containing the 5'—C-malonyl group on the antisense strands were evaluated and compared to the corresponding 5'-phosphorylated and non-phosphorylated counterparts.

Cell Culture and Transfection

Primary mouse hepatocytes were obtained from Life Technologies and cultured in Williams E Medium with 10% fetal bovine serum (FBS). Transfection was carried out by adding 4.9 µL of Opti-MEM plus 0.1 µL of Lipofectamine RNAiMax (Invitrogen) per well to 5 µL of each siRNA duplex at the desired concentration to an individual well in a 384-well plate. The mixture was incubated at room temperature for 20 minutes and 40 µL of complete growth media containing 5,000 cells was added to the siRNA mixture. Cells were incubated for 24 hours prior to RNA isolation. A similar procedure was followed for the transfection of 10,000,000 cells. Dose response experiments were done using eight 6-fold serial dilutions over the range of 20 nM to 75 pM or 50 nM to 187.5 pM.

RNA Isolation

RNA was isolated using Dynabeads mRNA Isolation Kit (Invitrogen). Cells were lysed in 75 µL of Lysis/Binding Buffer containing 3 µL of beads per well and mixed for 10 minutes on an electrostatic shaker. Buffers were prepared according to the manufacturer's protocol. The washing steps were automated on a Biotek EL406 using a magnetic plate support. Beads were washed (90 µL) once in Buffer A, once in Buffer B, and twice in Buffer E, with aspiration steps between washes.

cDNA synthesis cDNA synthesis was accomplished with the ABI High capacity cDNA reverse transcription kit (Applied Biosystems). A mixture of 1 µL 10× Buffer, 0.4 µL 25× dNTPs, 1 µL random primers, 0.5 µL reverse transcriptase, 0.5 µL RNase inhibitor, and 6.6 µL of water per reaction were added per well. Plates were sealed, agitated for 10 minutes on an electrostatic shaker, and then incubated at 37° C. for 2 hours. Following this, the plates were agitated at 80° C. for 8 minutes.

Real-Time PCR cDNA (2 µL) was added to a master mix containing 0.5 µL mouse GAPDH TaqMan Probe (Applied Biosystems, Cat.# 4308313), 0.5 µL mouse ApoB or PTEN TaqMan probes (Applied Biosystems, Cat.# Mm01545156_ml and Mm01212532_ml, respectively), and 5 µL Lightcycler 480 probe master mix (Roche) per well in a 384-well 50 plates (Roche). Real-time PCR was done in an ABI 7900HT RT-PCR system (Applied Biosystems) using the ΔΔCt (RQ) assay. Each duplex and concentration was tested in four biological replicates. To calculate relative fold change, real time data were analyzed using the ΔΔCt method and normalized to assays performed with cells transfected with 10 nM non-specific siRNA. $IC_{50}$ values were calculated using a 4-parameter fit model using XLFit.

TABLE 10

$IC_{50}$ values for 5'-C-malonyl, 5'-phosphate and 5'-OH siRNAs in PTEN and ApoB silencing in cell-based assays. Table 10 discloses SEQ ID NOS 215-232, respectively, in order of columns.

| siRNA target | 5'-modification | sense strand (5'-3')[a] | antisense strand (5'-3')[a] | $IC_{50}$ (nM)[b] |
|---|---|---|---|---|
| 1 ApoB | OH | C•c•UgGaCaUUCaGaAcAaGaAGalNAc | u•U•cUuGuUcUgaaUgUcCaGg•g•u | 1.0 |
| 2 ApoB | phosphate | C•c•UgGaCaUUCaGaAcAaGaAGalNAc | Pu•U•cUuGuUcUgaaUgUcCaGg•g•u | 0.1 |
| 3 ApoB | OH | U•g•UgAcAaAUAuGgGcAuCaAGalNAc | u•U•gAuGcCcAuauUuGuCaCa•a•a | 0.5 |
| 4 ApoB | phosphate | U•g•UgAcAaAUAuGgGcAuCaAGalNAc | Pu•U•gAuGcCcAuauUuGuCaCa•a•a | 0.1 |
| 5 ApoB | malonate | C•c•UgGaCaUUCaGaAcAaGaAGalNAc | Mu•U•cUuGuUcUgaaUgUcCaGg•g•u | 0.7 |
| 6 ApoB | malonate | U•g•UgAcAaAUAuGgGcAuCaAGalNAc | Mu•U•gAuGcCcAuauUuGuCaCa•a•a | 0.4 |

TABLE 10-continued

IC$_{50}$ values for 5'-C-malonyl, 5'-phosphate and 5'-OH siRNAs in PTEN and
ApoB silencing in cell-based assays. Table 10 discloses SEQ ID NOS 215-232,
respectively, in order of columns.

| siRNA target | 5'-modification | sense strand (5'-3')[a] | antisense strand (5'-3')[a] | IC$_{50}$ (nM)[b] |
|---|---|---|---|---|
| 7 PTEN | OH | AaGuAaGgAcCaGaGaCaAdT•dT | uUgUcUcUgGuCcUuAcUudT•dT | 0.7 |
| 8 PTEN | phosphate | AaGuAaGgAcCaGaGaCaAdT•dT | PuUgUcUcUgGuCcUuAcUudT•dT | 0.2 |
| 9 PTEN | malonate | AaGuAaGgAcCaGaGaCaAdT•dT | MuUgUcUcUgGuCcUuAcUudT•dT | 0.2 |

Note:
[a]P indicates 5'-monophosphate; M indicates 5'-malonate (i.e., 5'-C-malonyl); italicized upper case and normal lower case letters indicate 2'-deoxy-2'-fluoro (2'-F), and 2'-O-methyl (2'-OMe) sugar modifications, respectively; • indicates phosphorothioate (PS) linkage; dT indicates 2'-deoxythymidine nucleotide; GalNAc indicates hydroxyprolynyl tri-valent N-acetyl-galactosamine ligand (Nair et al., "Multivalent N-Acetylgalactosamine-Conjugated siRNA Localizes in Hepatocytes and Elicits Robust RNAi-Mediated Gene Silencing," J. Am. Chem. Soc. 136, 16958-16961 (2014), which is incorporated by reference in its entirety).
[b]half maximal inhibitory concentration (IC$_{50}$) for gene silencing in primary mouse hepatocytes. All values are from triplicate experiments.

Tritosome Stability Assay

Rat liver tritosomes (Xenotech, custom product PR14044) were thawed to room temperature and diluted to 0.5 units/mL in 20 mM sodium citrate buffer, pH 5.0. Samples were prepared by mixing 100 µL of 0.5 units/mL acid phosphatase tritosomes with 25 µL of 0.4 mg/mL siRNA in a microcentrifuge tube. After incubation for 4 hours or 24 hours in an Eppendorf Thermomixer set to 37° C. and 300 rpm, 300 µL of Phenomenex Lysis Loading Buffer and 12.5 µL of a 0.4 mg/mL internal standard siRNA were added to each sample. Samples for time 0 were prepared by mixing 100 µL of 0.5 units/mL acid phosphatase Tritosomes with 25 µL of 0.4 mg/mL siRNA sample, 300 µL of Phenomenex Lysis Loading Buffer, and 12.5 µL of a 0.4 mg/mL internal standard siRNA. siRNA was extracted from each time point sample (0 hour, 4 hours, 24 hours) using a Phenomenex Clarity OTX Starter Kit. The samples were then re-suspended with 500 µL of nuclease free water, and 50 µL of sample was analyzed by LC/MS.

RISC Immunoprecipitation and RT-PCR Assay siRNA-transfected primary mouse hepatocytes (10,000,000 cells) were lysed in lysis buffer (50 mM Tris-HCl, pH 7.5, 100 mM NaCl, 1% NP-40, 0.1% SDS) with protease inhibitor (Sigma-Aldrich). Lysate concentration was measured with a protein BCA kit (Thermo Scientific). For each reaction, 2 mg of total lysate was used. Anti-Ago2 antibody was purchased from Wako Chemicals (Clone No.: 2D4). Control mouse IgG was from Santa Cruz Biotechnology (sc-2025). Dynabeads (Life Technologies) were used to precipitate antibodies. Ago2-associated siRNA and endogenous miR122 were measured by Stem-Loop RT followed by TaqMan PCR analysis based on previously published methods.

Computational Simulation of the Interaction between 5'-deoxy-5'-C-Malonyluridine and the Human Ago2 MID Domain The recognition modes of available crystal structures of complexes between hAgo2 MID (amino acids 432-578; residues 440-572 are resolved in the electron density) and UMP (PDB ID code 3LUJ) and full-length hAgo2 and miR-20a (PDB ID code 4F3T) revealed that the recognition of 5'-terminal phosphates are very similar. The only difference between the two structures is that in the complex with full-length Ago2, a residue from the PIWI domain (Arg-812) makes a contribution to the recognition of the 5'-phosphate. The UMP:MID complex was therefore used as the basis for modeling the interaction between 5'-malonyluridine and the hAgo2 MID domain. Three-dimensional coordinates of the UMP:MID complex were retrieved from the Protein Data Bank (http://www.rcsb.org). Using the program UCSF Chimera (version 1.5.3), all water molecules from the crystal structure were deleted and the 5'-phosphate group was converted to the 5'—C-malonyl moiety. Hydrogen atoms were then added and the geometry of 5'-deoxy-5'—C-malonyluridine and its orientation and H-bonding/non-bonded interactions at the 5'-phosphate pocket of the hAgo2 MID domain optimized with the Amber force field (ff12SB and Gasteiger charges for standard amino acids and non-standard residues, respectively), as implemented in UCSF Chimera.

Figure 24:
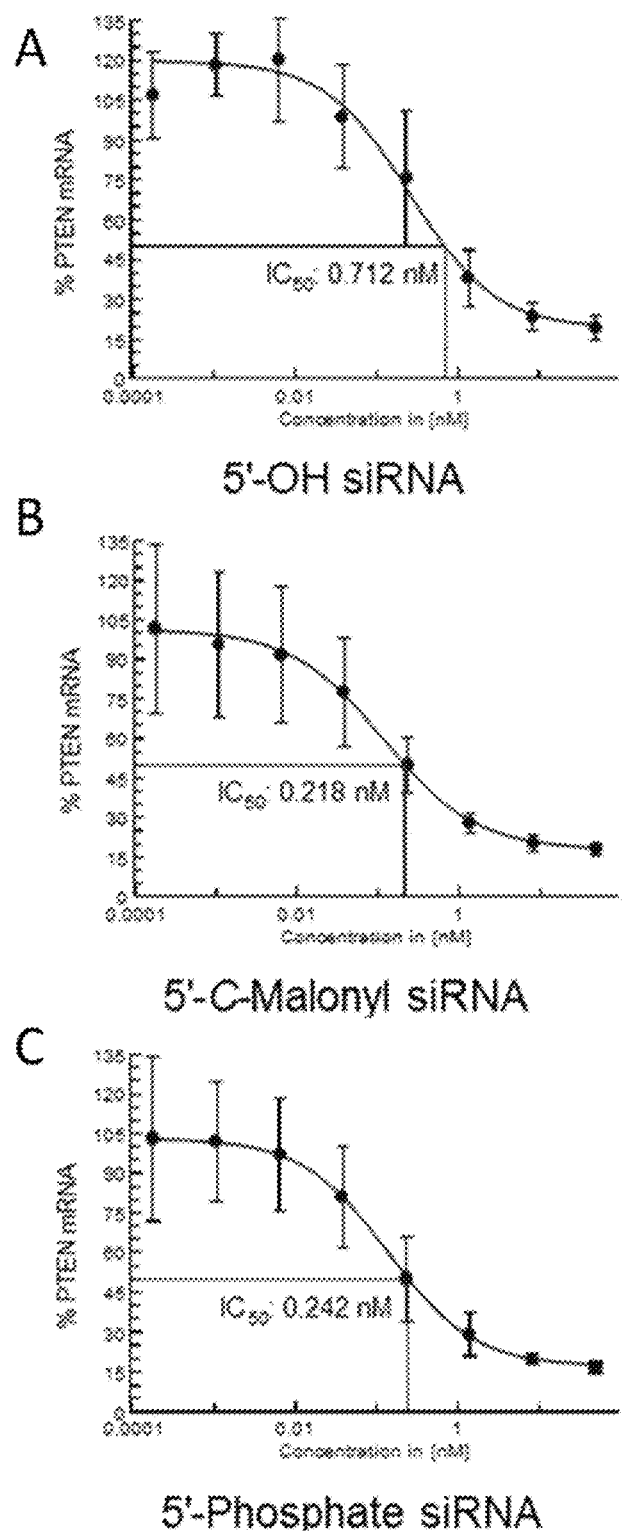
FIG. 24 shows graphs showing the dose-response curves for (A) 5'-OH, (B) 5'—C-malonyl, and (C) 5'-phosphate PTEN siRNAs in primary mouse hepatocytes in an in vitro PTEN silencing assay. All values are from triplicate experiments.

FIGS. 24A-C are graphs showing the dose-response curves for (A) 5'-OH, (B) 5'-C-malonyl, and (C) 5'-phosphate PTEN siRNAs in primary mouse hepatocytes in an in vitro PTEN silencing assay. All values are from triplicate experiments.

Figure 25:
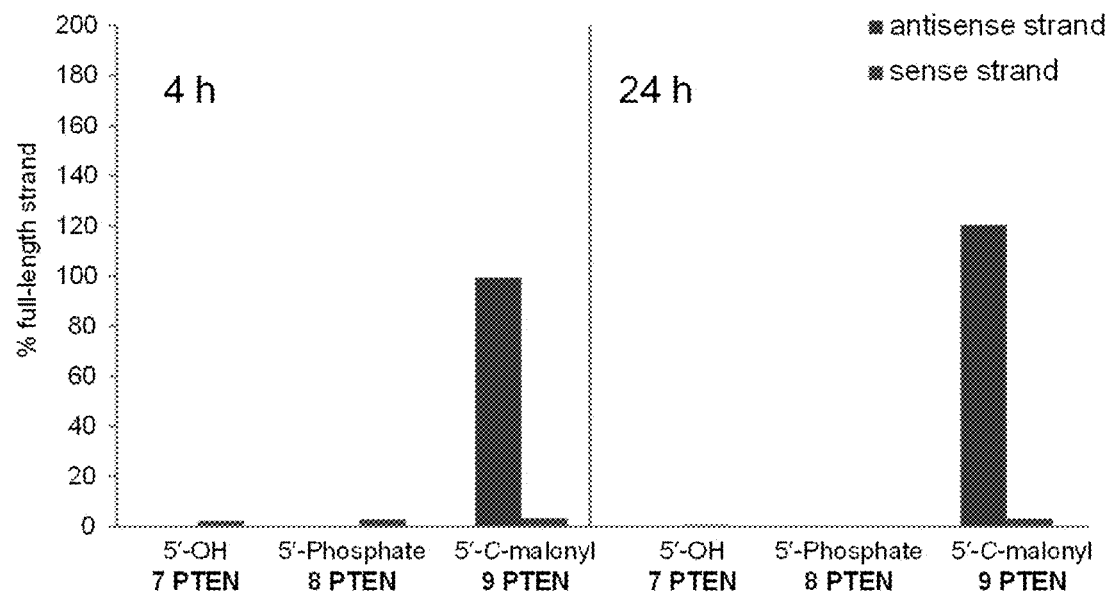
FIG. 25 shows the results of enzymatic stabilities of 5'-OH, 5'—C-malonyl, and 5'-phosphate siRNAs incubated in rat liver tritosomes. The siRNA target sequences are shown in Table 10. The data were normalized to untreated controls.

FIG. 25 shows the results of enzymatic stabilities of 5'-OH, 5'—C-malonyl, and 5'-phosphate siRNAs incubated in in rat liver tritosomes. The siRNA target sequences are shown in Table 10. The siRNAs were incubated at 0.4 mg/mL (approximately 5 mM) concentration for 4 hours and 24 hours, respectively, in the presence of tritosomes. Percent full-length strand was determined by HPLC. The data were normalized to untreated controls.

Figure 26:
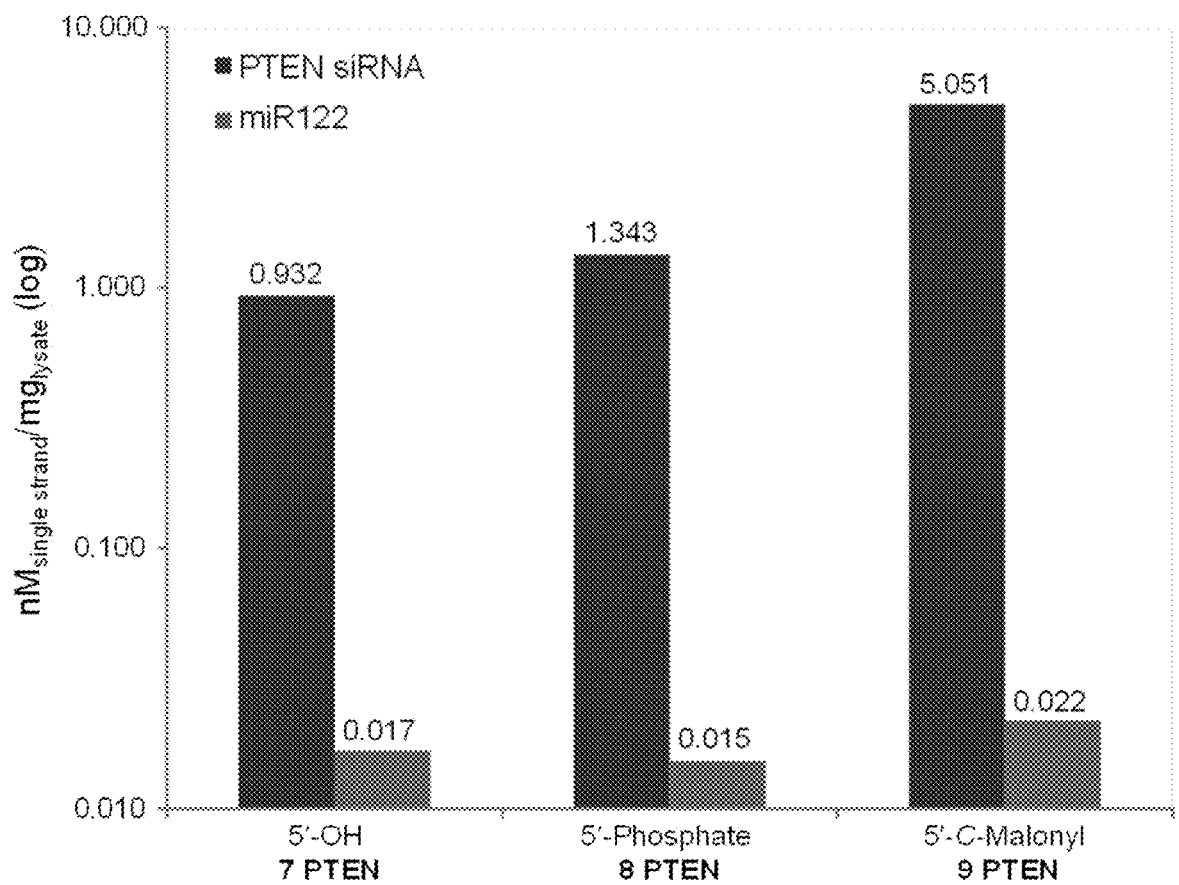
FIG. 26 shows the results of RISC loading of 5'-OH, 5'—C-malonyl, and 5'-phosphate siRNAs (5'-modification on the antisense strands) determined by immunoprecipitation of Ago2 from primary mouse hepatocytes and by RT-PCR amplification of the Ago2-loaded single strands. Levels of endogenous miR122 were determined as a control. The siRNA target sequences are shown in Table 10.

FIG. 26 shows the results of RISC loading of 5'-OH, 5'—C-malonyl, and 5'-phosphate siRNAs (5'-modification on the antisense strands) determined by immunoprecipitation of Ago2 from primary mouse hepatocytes and by RT-PCR amplification of the Ago2-loaded single strands. Levels of endogenous miR122 were determined as a control. The siRNA target sequences are shown in Table 10. siRNAs 7, 8, and 9 were transfected into cells at 10 nM. Levels of antisense strands of are given in nM siRNA strand per mg of cell lysate.

The results of these figures show that the 5'—C-malonyl siRNAs sustained or improved in vitro gene silencing, high levels of Ago2 loading, and conferred dramatically improved metabolic stability to the antisense strand of siRNA duplexes, as compared to the corresponding 5'-phosphorylated and non-phosphorylated counterparts. In silico modeling studies showed favorable fit of the 5'—C-malonyl group within the 5'-phosphate binding pocket of hAgo2 MID. Therefore, the 5'—C-malonyl, a metabolically stable 5'-phosphate bioisostere, has excellent biomimetic properties for use in therapeutic siRNAs.

Example 8: Process for Stereoselective Synthesis of 5'-C-alkyl Nucleosides using Trialkylaluminum or Dialkylzinc General Scheme for Synthesis of 5'-C-Alkyl Nucleosides by Addition of Mild Alkyl Nucleonhiles to 5'-Nucleoside Aldehydes Alternatively, instead of AlR'$_3$ or ZnR'$_2$ (listed above in Scheme 2), SnR'$_4$, TiR'$_4$, and various other metals, with the exception of Li and Mg, can be used with the R' group in this reaction scheme.

Scheme 3

General Scheme for Stereospecific Interconversion of Epimers of 5'-alkyl Nucleosides Through Anhydro-Ring Closure

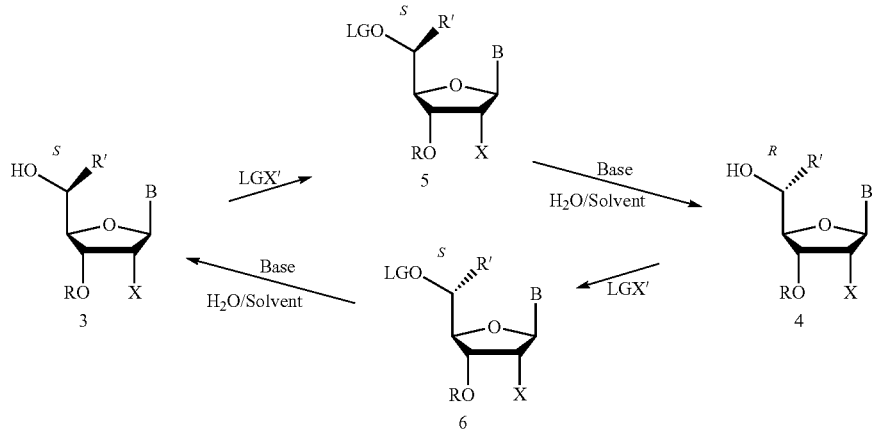

R = TBS, any protecting group, or any susbstituent
X = H, F, OH, OMe, OMOE, ONMA, OPG (PG - any protecting group), OR″ (R″ - any alkyl group)
B = unprotected or protected U, T, C, or any modified pyrimidine nucleobase
R' = Me or any alkyl substituent
LG = OMs, OTs, or any good leaving group
LGX' = MsCl, TsCl, or any strong acid choroanhydride or anhydride
Base = DBU or any base reagent
Solvent = THF, Dioxane or any water miscible organic solvent Scheme 4

Synthesis of Pyrimidine 5'-Aldehydes 2a-d Using Dess-Martin Periodinane

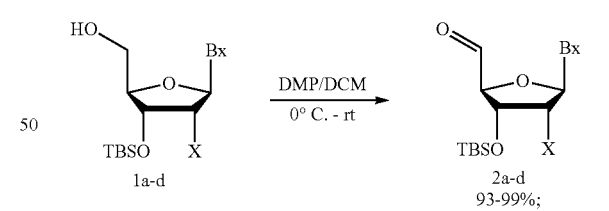

1a-d → 2a-d
93-99%;
Aldehyde content: 60-70%

(1-2)a: Bx = U, X = OMe
(1-2)b: Bx = U, X = F
(1-2)c: Bx = T• X = H
(1-2)d: Bx = C$^{Ac}$, X = OMe

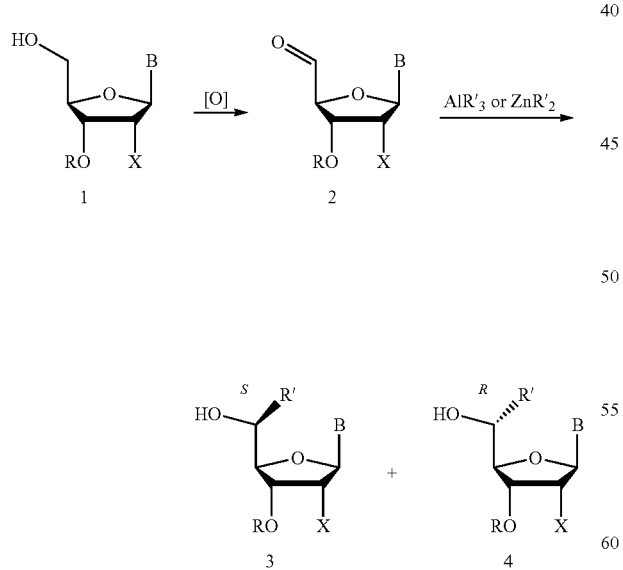

R = TBS, any protecting group, or any substituent
X = H, F, OMe, OMOE, ONMA, OPG (PG - any protecting group), OR″ (R″ - any alkyl group)
B = unprotected or protected U, T, C, A, G, or any modified nucleobase
R' = Me or any alkyl substituent 5'-Deoxy-3'-O-[(1,1-dimethylethyl)dimethylsilyl]-2'-O-methyl-5'-oxo-uridine 2a. Dess-Martin periodinane (40.7 g, 96 mmol) was added to a stirred and cooled (0° C.) solution of 3'-OTBS protected uridine 1a (29.8 g, 80 mmol) in anhydrous DCM (600 mL) under argon atmosphere. The cooling bath was removed and the mixture was stirred at room temperature for 4 hours, after which time no starting alcohol 1a could be observed by TLC. The mixture was cooled to 0° C. and poured to a vigorously stirred mixture of 10% solution of sodium thiosulfate (250 mL) and saturated solution of sodium bicarbonate (350 mL). After stirring at room temperature for 45 minutes significant precipitation occurred. The precipitate was filtered off and the solids where washed with DCM (200 mL×2). The filtrate was placed in a separatory funnel, the organic phase was separated and dried over anhydrous sodium sulfate. The solids from the filter funnel were transferred to an Erlenmeyer flask, acetone (450 mL) was added, the suspension was stirred for 15 minutes, filtered, and the solids were washed with acetone (200 mL×2). The acetone extract was evaporated, the residue was combined with DCM extract, the solvent was evaporated, the residue was dissolved in ACN-acetone 1:1 mixture (200 mL), the solvent was evaporated again, and the solid residue was dried in vacuum to afford crude aldehyde 2a 27.6 g (93%). Aldehyde content approximately 71% (determined by CHO/NH ratio of $H^1$ NMR in ACN-$d_3$) that was used in the next step without of further purification. The product could be stored without of notable decomposition at −20° C. under argon atmosphere. $^1$H NMR of major component (400 MHz, ACN-$d_3$): δ 0.15 (s, 6H); 0.93 (s, 9H); 3.37 (s, 3H); 3.62-3.68 (m, 2H); 3.81 (dd, J=4.6, 5.9 Hz, 1H); 4.48 (d, J=3.4 Hz, 1H); 4.59 (ddd, J=0.4, 3.4, 4.5 Hz, 1H); 5.70 (d, J=8.2 Hz, 1H); 5.94 (d, J=6.0 Hz, 1H); 7.71 (d, J=8.2 Hz, 1H); 9.17 (bs, 1H); 9.68 (d, J=0.5 Hz, 1H).

2',5'-Dideoxy-3'-O-[(1,1-dimethylethyl)dimethylsilyl]-2'-fluoro-5'-oxo-uridine 2b was prepared analogously from 1b (13.8 g, 38 mmol) and DMP (19.5 g, 46 mmol) in anhydrous DCM (550 mL). After stirring overnight at room temperature, the mixture was cooled, quenched, and extracted with DCM to afford 12.7 g (93%) of crude aldehyde containing approximately 60% of the title product 2b. $^1$H NMR of major component (400 MHz, ACN-$d_3$): δ 0.13 (s, 3H); 0.14 (s, 3H); 0.92 (s, 9H); 4.41 (d, J=6.0 Hz, 1H); 4.67 (ddd, J=4.9, 6.0, 13.6 Hz, 1H); 5.15 (ddd, J=2.8, 4.9, 52.5 Hz, 1H); 5.68 (d, J=8.1 Hz, 1H); 5.89 (dd, J=2.8, 18.3 Hz, 1H); 7.55 (d, J=8.1 Hz, 1H); 9.26 (bs, 1H); 9.64 (d, J=1.0 Hz, 1H).

5'-Deoxy-3'-O-[(1,1-dimethylethyl)dimethylsiyl]-5'-oxo-thymidine 2c was prepared analogously from 1c (17.9 g, 50 mmol) and DMP (25.4 g, 60 mmol) in anhydrous DCM (500 mL). After stirring for 3 hours at 0° C., the mixture was quenched and extracted with DCM to afford 20.0 g (quant.) of crude aldehyde containing approximately 63% of the title product 2c. $^1$H NMR of major component (400 MHz, ACN-$d_3$): δ 0.135 (s, 3H); 0.140 (s, 3H); 0.92 (s, 9H); 1.85 (d, J=1.2 Hz, 3H); 2.08-2.24 (m, 2H); 4.38 (d, J=2.2 Hz, 1H); 4.75 (dt, J=2.2, 5.7 Hz, 1H); 6.24 (dd, J=6.2, 7.9 Hz, 1H); 7.55 (d, J=1.3 Hz, 1H); 9.18 (bs, 1H); 9.65 (d, J=0.5 Hz, 1H).

N-Acetyl-5'-deoxy-3'-O-[(1,1-dimethylethyl)dimethylsilyl]-2'-O-methyl-5'oxo-cytidine 2d was prepared analogously from 1d (33.1 g, 80 mmol) and DMP (40.7 g, 96 mmol) in anhydrous DCM (600 mL). After stirring at room temperature for 4 hours, the mixture was quenched and treated analogously to the case of 2a to afford crude aldehyde 33.2 g (100%) containing approximately 56% of the title product 2d. $^1$H NMR of major component (400 MHz, ACN-$d_3$): δ 0.108 (s, 3H); 0.117 (s, 3H); 0.92 (s, 9H); 2.14 (s, 3H); 3.44 (s, 3H); 3.90-3.94 (m, 1H); 4.49-4.52 (m, 2H); 5.92 (d, J=3.8 Hz, 1H); 7.33 (d, J=7.5 Hz, 1H); 8.10 (d, J=7.5 Hz, 1H); 9.13 (bs, 1H); 9.72 (s, 1H).

Synthesis of Purine 5'-Aldehydes 2e-f using Dess-Martin Periodinane, "Water-Free quench"

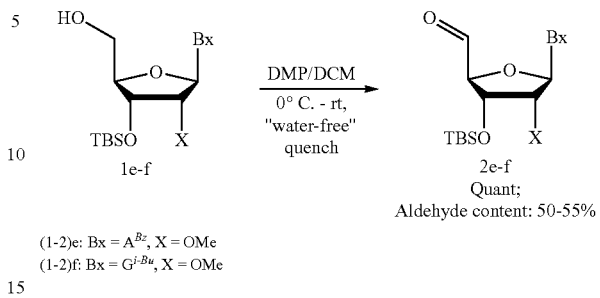

(1-2)e: Bx = $A^{Bz}$, X = OMe
(1-2)f: Bx = $G^{i\text{-}Bu}$, X = OMe

N-Benzoyl-5'-deoxy-3'-O-[(1,1-dimethylethyl)dimethylsily]-2'-O-methyl-5'-oxo-adenosine 2e. Dess-Martin periodinane (20.4 g, 48 mmol) was added to a stirred and cooled (0° C.) solution of 3'-OTBS protected adenosine 11e (20.0 g, 40 mmol) in anhydrous DCM (300 mL) under argon atmosphere. The cooling bath was removed and the mixture was stirred at room temperature for 3 hours, after which time no starting alcohol 1e could be observed by TLC. Isopropyl alcohol (0.61 mL, 8 mmol) was added and the stirring was continued for an additional 1 hour. The solvent was removed in vacuum, and ethyl acetate (220 mL) was added followed by slow addition of hexanes (150 mL) over 4 hours with stirring. The mixture was stirred at room temperature overnight, filtered, and the solids were washed twice with ethyl acetate—hexanes (1:1) mixture. The filtrate was evaporated in vacuum and the residue was co-evaporated with dry acetonitrile (300 mL). Acetonitrile (100 mL) was added to form a suspension that was stirred overnight, filtered, and the solids were washed twice with acetonitrile. The filtrate was evaporated in vacuum to afford white foamy residue that was dried under high vacuum to afford 20.2 g (100%) of crude aldehyde containing approximately 54% of the title product 2e, that was used in the next step without of further purification. $^1$H NMR of major component (400 MHz, ACN-$d_3$): δ 0.188 (s, 3H); 0.190 (s, 3H); 0.97 (s, 9H); 3.34 (s, 3H); 4.49 (dd, J=4.3, 6.3 Hz, 1H); 4.51 (dd, J=1.0, 2.9 Hz, 1H); 4.90 (dd, J=3.0, 4.2 Hz, 1H); 6.24 (d, J=6.3 Hz, 1H); 7.54 (t, J=7.3 Hz, 2H); 7.61-7.67 (m, 1H); 7.97-8.03 (m, 2H); 8.44 (s, 1H); 8.66 (s, 1H); 9.50 (bs, 1H); 9.82 (d, J=1.0 Hz, 1H).

N-Isobuturyl-5'-deoxy-3'-O-[(1,1-dimethylethyl)dimethylsilyl]-2'-O-methyl-5'-oxo-guanosine 2f was prepared analogously from 1f (19.3 g, 40 mmol) and DMP (20.4 g, 48 mmol) in anhydrous DCM (300 mL). After stirring for 3 hours at room temperature, isopropyl alcohol (0.61 mL, 8 mmol) was added, and the stirring was continued for an additional 1 hour. The solvent was removed in vacuum, and ethyl acetate (225 mL) was added followed by slow addition of hexanes (150 mL) over 30 minutes with stirring. The mixture was stirred at room temperature for 5 hours, filtered, and the solids were washed twice with ethyl acetate—hexanes (1:1.5) mixture. The filtrate was evaporated in vacuum and the residue was co-evaporated with a mixture of toluene (250 mL) and dry acetonitrile (250 mL) followed by acetonitrile (250 mL). The white foamy residue was dried in high vacuum to afford 21.5 g of crude aldehyde containing approximately 53% of the title product 2f, that was used in the next step without of further purification. $^1$H NMR of major component (400 MHz, ACN-$d_3$): δ 0.167 (s, 3H); 0.175 (s, 3H); 0.95 (s, 9H); 1.18 (d, J=6.8 Hz, 3H); 1.19 (d, J=6.8 Hz, 3H); 2.66-2.77 (m, 1H); 3.31 (s, 3H); 4.31 (dd, J=4.3, 7.0 Hz, 1H); 4.48 (dd, J=1.0, 2.3 Hz, 1H); 4.69 (ddd, J=0.4, 2.4, 4.3 Hz, 1H); 6.01 (d, J=7.0 Hz, 1H); 8.03 (s, 1H); 9.45 (s, 1H); 9.79 (d, J=1.1 Hz, 1H); 12.05 (bs, 1H).

Stereoselective Addition of Mild Me-Nucleophiles to Nucleoside 5'-Aldehydes.

a. General Observations.

Nucleobase-dependence of stereoselectivity: As shown in the tables below, (S)-epimers of 5'-Me pyrimidine nucleosides can be synthesized with high level of stereoselectivity using trimethylaluminum (as shown in the table for AlMe$_3$), whereas (S)-epimers of 5'-Me purines can be synthesized stereoselectively using dimethylzinc (as shown in the table for ZnMe$_2$).

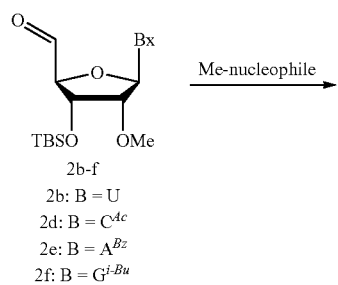

2b-f
2b: B = U
2d: B = C$^{Ac}$
2e: B = A$^{Bz}$
2f: B = G$^{i-Bu}$

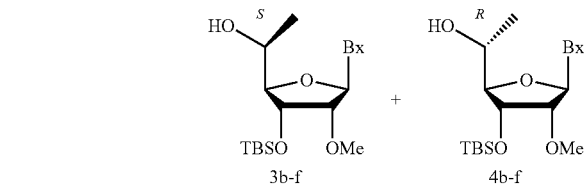

3b-f    4b-f

| | AlMe$_3$ (S:R) | | | |
|---|---|---|---|---|
| Solvent/T (° C.) | U | C$^{Ac}$ | A$^{Bz}$ | G$^{i-Bu}$ |
| THF (0-rt) | 12:1 | 9:1 | 1:1 | Slow 1:2 |
| DCM (−78-rt) | 3.9:1 | | 2:1 | 1:1 |
| Toluene (−78-rt) | 3.4:1 | | 3:1 | |

| | ZnMe$_2$ (S:R) | | | |
|---|---|---|---|---|
| Solvent/T (° C.) | U | C$^{Ac}$ | A$^{Bz}$ | G$^{i-Bu}$ |
| THF (0-rt) | NR | | Slow 2:1 | |
| DCM/Toluene (−78-rt) | Very slow | | 9:1 | 3:1 |

Solvent-dependence of stereoselectivity: As shown in the tables, (S)-epimers of 5'-Me pyrimidine nucleosides can be synthesized with high level of stereoselectivity using trimethylaluminum in THF (as shown in the tables for AlMe$_3$), whereas (S)-epimers of 5'-Me purines can be synthesized stereoselectively using dimethylzinc in a non-coordinating solvent (as shown in the tables for ZnMe$_2$). The equimolar mixture of purine stereoisomers can be obtained with trimethylaluminum either in THF (for A derivatives), or in a non-coordinating solvent (DCM) (for G-derivatives).

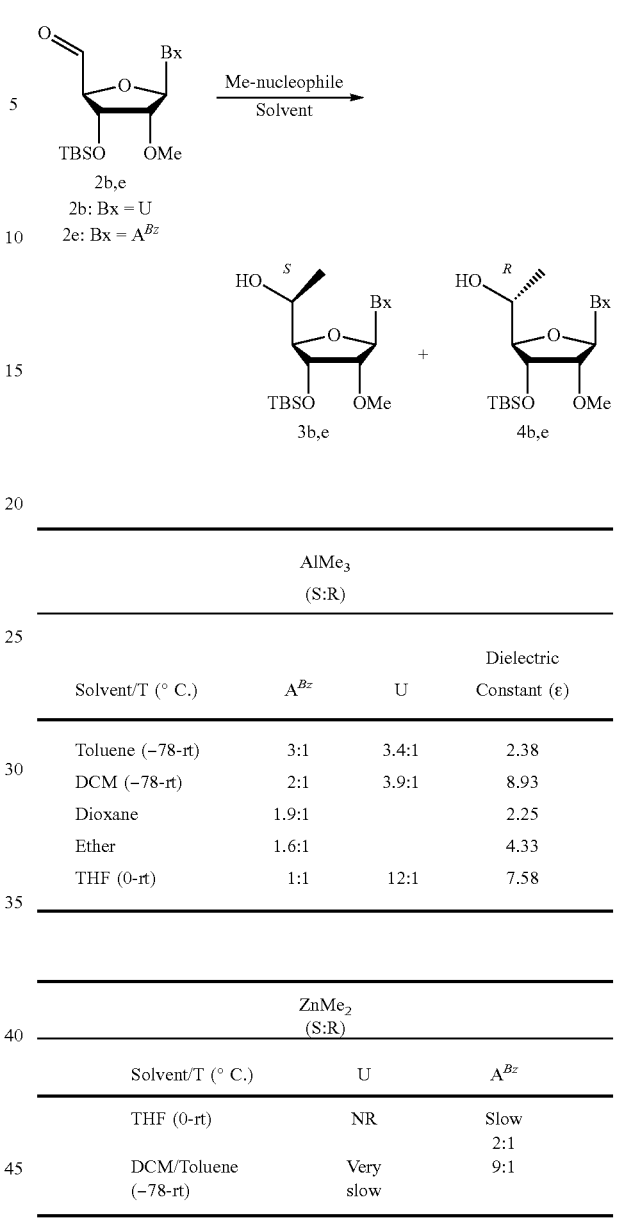

2b,e
2b: Bx = U
2e: Bx = A$^{Bz}$ 3b,e    4b,e

| | AlMe$_3$ (S:R) | | |
|---|---|---|---|
| Solvent/T (° C.) | A$^{Bz}$ | U | Dielectric Constant (ε) |
| Toluene (−78-rt) | 3:1 | 3.4:1 | 2.38 |
| DCM (−78-rt) | 2:1 | 3.9:1 | 8.93 |
| Dioxane | 1.9:1 | | 2.25 |
| Ether | 1.6:1 | | 4.33 |
| THF (0-rt) | 1:1 | 12:1 | 7.58 |

| | ZnMe$_2$ (S:R) | |
|---|---|---|
| Solvent/T (° C.) | U | A$^{Bz}$ |
| THF (0-rt) | NR | Slow 2:1 |
| DCM/Toluene (−78-rt) | Very slow | 9:1 |

Dependence of stereoselectivity on 2'-substitution: coordinating and more bulky 2'-OMe substituent gave better selectivity than smaller, non-coordinating 2'-F or 2'-H.

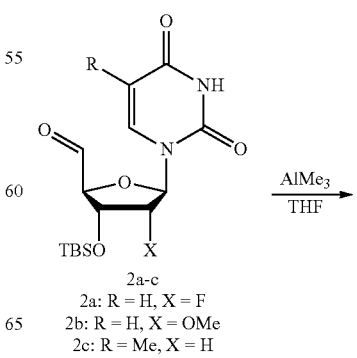

2a-c
2a: R = H, X = F
2b: R = H, X = OMe
2c: R = Me, X = H

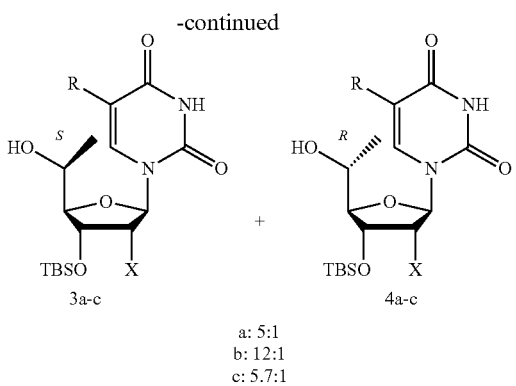

a: 5:1
b: 12:1
c: 5.7:1 b. Procedure for the reaction of 5'-oxo-nucleosides with trimethylaluminum.

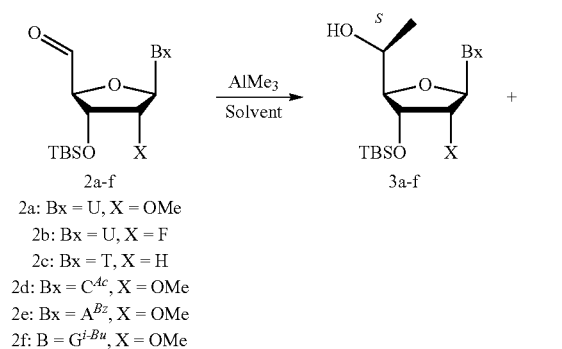

2a: Bx = U, X = OMe
2b: Bx = U, X = F
2c: Bx = T, X = H
2d: Bx = C$^{Ac}$, X = OMe
2e: Bx = A$^{Bz}$, X = OMe
2f: B = G$^{i\text{-}Bu}$, X = OMe 5'-(S)-C-Methyl-3'-O-[(1,1-dimethylethyl)dimethylsilyl]-2'-O-methyl-uridine 3a and 5'-(R)-C-Methy-3'-O-[(1,1-dimethylethyl)dimethylsilyl]-2'-O-methyl-uridine 4a. A solution of crude aldehyde 2a, containing approximately 68% of the title compound (25.3 g, ≤68 mmol) in anhydrous THF (200 mL) was slowly added via cannula for approximately 15 minutes to a stirred and cooled (0° C.) mixture of AlMe$_3$ (2 M in heptane, 102 mL, 204 mmol) and anhydrous THF (200 mL) under argon atmosphere. The cooling bath was removed, the mixture was stirred at room temperature for 17 hours, cooled to 0° C. and the reaction was quenched by cautious addition of 500 mL of 1:1 mixture of saturated aqueous solution of ammonium chloride and 20% phosphoric acid followed by addition of 400 mL of ethylacetate. The organic phase was separated, washed twice with saturate brine, dried over anhydrous sodium sulfate, and the solvent was removed in vacuum to afford 25.6 g of crude residue. Flash column chromatography of the residue on a 330 g CombiFlash silica gel column with gradient (50 to 90%) of ethyl acetate containing 1% of triethylamine in hexanes afforded 3a (17.5 g, 67%), and a mixture of 3a and 4a (1.25 g, 5%). The latter was dissolved in 15 mL of hot ethyl acetate followed by slow addition of 15 mL of hexanes. The mixture was allowed to cool to room temperature, stirred overnight, the precipitate was filtered, washed with ethyl acetate-hexanes 1:2 mixture and dried to afford pure 4a (0.81 g, 65% on crystallization, 3% on reaction). 3a: $^1$H NMR (400 MHz, DMSO-d$_6$): δ 0.08 (s, 6H); 0.87 (s, 9H); 1.14 (d, J=6.7 Hz, 3H); 3.33 (s, 3H); 3.68 (dd, J=1.8, 4.4 Hz, 1H); 3.76-3.84 (m, 2H); 4.27 (t, J=4.6 Hz, 1H, H2'); 5.17 (d, J=4.4 Hz, 1H, OH); 5.65 (d, J=8.1 Hz, 1H); 5.83 (d, J=4.7 Hz, 1H, H1'); 8.05 (d, J=8.1 Hz, 1H); 11.3 (s, 1H). $^{13}$C NMR (126 MHz, DMSO-d$_6$): δ −4.95; −4.82; 17.78; 20.05; 25.61; 57.56; 64.73; 70.57; 82.61; 85.83; 87.96; 101.79; 140.19; 150.48; 163.08. HRMS m/z calc. for [C$_{17}$H$_{30}$N$_2$O$_6$Si+H]$^+$: 387.1951; found: 387.1962. 4a: $^1$H NMR (400 MHz, DMSO-d$_6$): δ 0.09 (s, 6H); 0.88 (s, 9H); 1.10 (d, J=6.6 Hz, 3H); 3.28 (s, 3H); 3.64 (dd, J=2.2, 4.2 Hz, 1H, H4'); 3.77 (dt, J=4.6, 6.5 Hz, 1H, H5'); 3.86 (dd, J=4.8, 6.8 Hz, 1H, H2'); 4.40 (dd, J=2.2, 4.7 Hz, 1H, H3'); 5.16 (d, J=4.9 Hz, 1H, OH); 5.67 (dd, J=2.2, 8.1 Hz, 1H); 5.86 (d, J=6.8 Hz, 1H, H1'); 7.89 (d, J=8.2 Hz, 1H); 11.36 (d, J=1.8 Hz, 1H). $^{13}$C NMR (126 MHz, DMSO-d$_6$): δ 0.60; 0.69; 23.19; 25.19; 62.84; 71.50; 74.48; 87.10; 90.47; 94.80; 107.69; 145.93; 156.11; 168.37. HRMS m/z calc. for [C$_{17}$H$_{30}$N$_2$O$_6$Si+H]$^+$: 387.1951; found: 387.1960.

5'-(S)-C-Methyl-2'-deoxy-3'-O-[(1,1-dimethylethyl)dimethylsilyl]-2'-fluoro-uridine 3b and 5'-(R)-C-Methyl-2'-deoxy-3'-O-[(1,1-dimethylethyl)dimethylsilyl]-2'-fluoro-uridine 4b were prepared analogously by addition of a solution of crude aldehyde 2b containing approximately 55% of the title compound (1.80 g, ≤5 mmol) in anhydrous THF (10 mL) to a mixture of AlMe$_3$ (2 M in heptane, 8 mL, 16 mmol) and anhydrous THF (10 mL) at 0° C. under argon atmosphere, followed by stirring at room temperature overnight. The crude residue (1.88 g) was chromatographed over a 80 g CombiFlash silica gel column with 50% of ethyl acetate containing 1% of triethylamine in hexanes to afford 3b (0.88 g, 47%), and 4b (0.17 g, 9%) along with small intermediate mixed fraction. 3b: $^1$H NMR (400 MHz, DMSO-d$_6$): δ 0.088 (s, 3H); 0.094 (s, 3H); 0.86 (s, 9H); 1.19 (d, J=6.5 Hz, 3H); 3.72 (d, J=6.8 Hz, 1H); 3.75-3.83 (m, 1H); 4.31 (ddd, J=4.4, 6.8, 18.3 Hz, 1H, H3); 5.06 (ddd, J=2.4, 4.4, 53.1 Hz, 1H, H2'); 5.20 (d, J=4.7 Hz, 1H, OH); 5.63 (d, J=8.1 Hz, 1H); 5.91 (dd, J=2.3, 16.9 Hz, 1H, H1'); 7.99 (d, J=8.1 Hz, 1H); 11.4 (s, 1H). $^{13}$C NMR (126 MHz, acetone-d$_6$): δ −4.84; −4.53; 18.75; 20.70; 26.14; 66.02; 71.29; 71.42; 87.98; 88.50; 88.77; 93.20; 94.71; 102.58; 141.37; 151.41; 163.74. $^{19}$F NMR (376 MHz, acetone-d$_6$): δ −207.60 (dt, J=16.6, 53.1 Hz, 1F). HRMS m/z calc. for [C$_{16}$H$_{27}$FN$_2$O$_5$Si+H]$^+$: 375.1752; found: 375.1744. 4b: $^1$H NMR (400 MHz, DMSO-d$_6$): δ 0.096 (s, 3H); 0.102 (s, 3H); 0.87 (s, 9H); 1.11 (d, J=6.7 Hz, 3H); 3.74-3.78 (m, 1H); 3.84-3.94 (m, 1H); 4.43 (dt, J=4.8, 12.2 Hz, 1H, H3); 5.10 (dt, J=4.2, 52.8 Hz, 1H, H2); 5.21 (d, J=4.7 Hz, 1H, OH); 5.65 (d, J=8.1 Hz, 1H); 5.94 (dd, J=4.0, 15.8 Hz, 1H, H1'); 7.89 (d, J=8.1 Hz, 1H); 11.4 (s, 1H). $^{13}$C NMR (126 MHz, CD$_3$OD): δ −4.56; −4.10; 19.11; 19.89; 26.45; 67.67; 70.62; 70.74; 88.28; 88.55; 89.99; 92.89; 94.40; 103.39; 142.71; 152.28; 165.67. $^{19}$F NMR (376 MHz, acetone-d6): δ −208.28 (dt, J=14.3, 52.8 Hz, 1F). HRMS m/z calc. for [C$_{16}$H$_{27}$FN$_2$O$_5$Si+H]$^+$: 375.1752; found: 375.1760.

5'-(S)-C-Methyl-3'-O-[(1,1-dimethylethyl)dimethylsilyl]-thymidine 3c and 5'-(R)-C-Methyl-3'-O-[(1,1-dimethylethyl)dimethylsilyl]-thymidine 4c were prepared analogously by addition of a solution of crude aldehyde 2c containing approximately 60% of the title compound (1.21 g, ≤3.4 mmol) in anhydrous THF (10 mL) to a mixture of AlMe$_3$ (2 M in heptane, 6 mL, 12 mmol) and anhydrous THF (10 mL) at 0° C. under argon atmosphere, followed by stirring at room temperature overnight. The crude residue (1.21 g) was chromatographed over 2 consecutive silica gel flash-columns (CombiFlash 80 g and 24 g) with gradient (80 to 100%) of ethyl ether containing 1% of triethylamine in hexanes. The fractions containing separated epimers were pulled separately, and intermediate mixed fractions were combined and subjected to the second column chromatography. Obtained 0.65 g (52%) of 3c and 0.11 g (9%) of 4c along with small intermediate mixed fraction. 3c: $^1$H NMR (400 MHz, DMSO-$d_6$): δ 0.07 (s, 6H); 0.86 (s, 9H); 1.13 (d, J=6.5 Hz, 3H); 1.76 (d, J=1.0 Hz, 3H); 2.01 (ddd, J=3.0, 6.0, 13.2 Hz, 1H, H2'$_A$); 2.13 (ddd, J=5.9, 7.7, 13.4 Hz, 1H, H2'$_B$); 3.58 (t, J=2.7 Hz, 1H, H4'); 3.74-3.83 (m, 1H, H5'); 4.40 (quintet, J=2.8 Hz, 1H, H3'); 5.02 (d, J=4.6 Hz, 1H, OH); 6.15 (dd, J=6.0, 7.7 Hz, 1H, H1'); 7.84 (d, J=1.2 Hz, 1H); 11.27 (s, 1H). $^{13}$C NMR (126 MHz, ACN-$d_3$): δ −4.58; −4.39; 12.72; 18.63; 20.65; 26.20; 41.14; 67.55; 73.94; 85.97; 97.74; 111.06; 137.89; 151.76; 165.10. HRMS m/z calc. for $[C_{17}H_{30}N_2O_5Si+Na]^+$: 393.1822; found: 393.1825. 4c: $^1$H NMR (400 MHz, DMSO-$d_6$): δ 0.081 (s, 3H); 0.084 (s, 3H); 0.87 (s, 9H); 1.10 (d, J=6.5 Hz, 3H); 1.76 (d, J=1.1 Hz, 3H); 1.95 (ddd, J=1.7, 5.5, 13.1 Hz, 1H, H2'$_A$); 2.14 (ddd, J=5.4, 9.0, 13.2 Hz, 1H, H2'$_B$); 3.55 (dd, J=1.6, 4.7 Hz, 1H, H4'); 3.73 (dt, J=4.9, 6.4 Hz, 1H, H5'); 4.49 (dt, J=1.4, 5.3 Hz, 1H, H3'); 5.03 (d, J=5.0 Hz, 1H, OH); 6.15 (dd, J=5.5, 8.9 Hz, 1H, H1'); 7.66 (d, J=1.2 Hz, 1H); 11.29 (s, 1H). $^{13}$C NMR (126 MHz, ACN-$d_3$): δ−4.52; −4.25; 12.67; 18.55; 20.21; 26.19; 41.10; 68.26; 72.46; 86.07; 92.35; 111.27; 137.75; 151.83; 165.09. HRMS m/z calc. for $[C_{17}H_{30}N_2O_5Si+H]^+$: 371.2002; found: 371.1992.

N-Acetyl-5'-(S)-C-methyl-3'-O-[(1,1-dimethylethyl)dimethylsilyl]-2'-O-methyl-cytidine 3d was prepared analogously by addition of a solution of crude aldehyde 2d containing approximately 56% of the title compound (2.80 g, ≤6.8 mmol) in anhydrous THF (20 mL) to a mixture of AlMe$_3$ (2 M in heptane, 12 mL, 24 mmol) and anhydrous THF (20 mL) at 0° C. under argon atmosphere, followed by stirring at room temperature overnight. The crude residue (3.03 g) was chromatographed over 2 consecutive silica gel flash-columns (CombiFlash 80 g and 40 g) with gradient (70 to 100%) of ethyl acetate in hexanes to afford 1.09 g (37%) of less-polar (S)-epimer 3d along with 0.60 g of more polar fraction containing mixture of 3d and 4d that was not further separated. 3d: $^1$H NMR (400 MHz, DMSO-$d_6$): δ 0.05 (s, 6H); 0.85 (s, 9H); 1.21 (d, J=6.5 Hz, 3H); 2.09 (s, 3H); 3.43 (s, 3H); 3.70-3.76 (m, 2H); 3.77-3.85 (m, 1H); 4.21 (dd, J=4.8, 7.0 Hz, 1H); 5.19 (d, J=4.4 Hz, 1H); 5.83 (d, J=2.0 Hz, 1H); 7.18 (d, J=7.5 Hz, 1H); 8.58 (d, J=7.5 Hz, 1H); 10.90 (s, 1H).

Note: N-Acetyl cytidines are not very stable on silica gel column in the presence of triethylamine and tend to undergo disproportionation to form N-deprotected and N-diacetylated derivatives. Therefore, no triethylamine was used to separate the isomers 3d and 4d. However, addition of triethylamine is useful for better separation of the isomers on TLC.

N-Benzoyl-5'-(S)-C-methyl-3'-O-[(1,1-dimethylethyl)dimethylsilyl]-2'-O-methyl-adenosine 3e and N-benzoyl-5'-(R)-C-methyl-3'-O-[(1,1-dimethylethyl)dimethylsilyl]-2'-O-methyl-adenosine 4e were prepared analogously by addition of a solution of crude aldehyde 2e containing approximately 50% of the title compound (16.9 g, ≤34 mmol) in anhydrous THF (100 mL) to a mixture of AlMe$_3$ (2 M in heptane, 51 mL, 102 mmol) and anhydrous THF (100 mL) at 0° C. under argon atmosphere, followed by stirring at room temperature overnight. The crude residue (15.9 g) was chromatographed over a silica gel flash-column (CombiFlash 220 g) with gradient (70 to 100%) of ethyl acetate in hexanes to afford purified mixture of epimers (~1:1): 8.52 g, 49%. The isomers were further separated by prep. C18 RP-HPLC using a Gilson PLC 2020 purification system: 1 g of mixture was injected and eluted using an isocratic method with 25 mM triethylammonium bicarbonate and 65% acetonitrile. Appropriate fractions with HPLC purity of >95% were pooled and evaporated to dryness to afford 0.15 g of 3e (dr >97%), and 0.25 g of 4e pure stereoisomer. 3e: $^1$H NMR (400 MHz, DMSO-$d_6$): δ 0.124 (s, 3H); 0.126 (s, 3H); 0.91 (s, 9H); 1.17 (d, J=6.4 Hz, 3H); 3.32 (s, 3H); 3.81-3.90 (m, 2H); 4.40 (dd, J=4.9, 5.7 Hz, 1H); 4.54 (dd, J=3.2, 4.5 Hz, 1H); 5.19 (d, J=5.7 Hz, 1H); 6.16 (d, J=5.7 Hz, 1H); 7.55 (t split, J=7.8 Hz, 2H); 7.64 (t split, J=7.4 Hz, 1H); 8.03 (d, J=1.4 Hz, 1H); 8.05 (s, 1H); 8.76 (s, 1H); 8.80 (s, 1H); 11.23 (s, 1H). 4e: $^1$H NMR (500 MHz, DMSO-$d_6$): δ 0.146 (s, 3H); 0.147 (s, 3H); 0.93 (s, 9H); 1.10 (d, J=6.4 Hz, 3H); 3.25 (s, 3H); 3.75 (dd, J=1.1, 5.6 Hz, 1H); 3.89 (sextet, J=5.7 Hz, 1H); 4.60 (dd, J=4.5, 7.4 Hz, 1H); 4.63 (dd, J=1.2, 4.6 Hz, 1H); 5.32 (d, J=4.7 Hz, 1H); 6.11 (d, J=7.4 Hz, 1H); 7.55 (t, J=8.0 Hz, 2H); 7.64 (t split, J=7.5 Hz, 1H); 8.03 (d, J=1.4 Hz, 1H); 8.05 (d, J=0.9 Hz, 1H); 8.76 (s, 1H); 8.77 (s, 1H); 11.23 (s, 1H).

N-Isobutyryl-5'-(S)-C-methyl-3'-O-[(1,1-dimethylethyl) dimethylsilyl]-2'-O-methyl-guanosine 3f and N-Isobutyryl-5'-(R)-C-methyl-3'-O-[(1,1-dimethylethyl)dimethylsilyl]-2'-O-methyl-guanosine 4f were prepared analogously by addition of a solution of crude aldehyde 2f containing approximately 53% of the title compound (1.63 g, ≤3.4 mmol) in anhydrous DCM (10 mL) to a mixture of AlMe$_3$ (2 M in heptane, 10 mL, 20 mmol) and anhydrous DCM (10 mL) at −78° C. under argon atmosphere, followed by slow (in bath) warming up to room temperature overnight. The crude residue (1.59 g) was chromatographed over a silica gel flash-column (CombiFlash 40 g) with gradient (0 to 4%) of methanol in chloroform to afford 0.14 g of less polar (R)-isomer 4f, 0.36 g of intermediate mixture of 3f and 4f and 0.25 g of more polar (S)-isomer 3f. The intermediate fraction was separated on the second isocratic column (CombiFlash 40 g) with 3% of methanol in chloroform to afford additional 0.20 g of 4f and 0.16 g of 3f. Total yield of 3f: 0.34 g (23%) and 4f: 0.41 g (27%). 3f: $^1$H NMR (400 MHz, DMSO-$d_6$): δ 0.10 (s, 3H); 0.11 (s, 3H); 0.89 (s, 9H); 1.11 (d, J=6.8 Hz, 6H); 1.12 (d, J=6.4 Hz, 3H); 2.77 (septet, J=6.8 Hz, 1H); 3.29 (s, 3H); 3.76 (t, J=2.6 Hz, 1H); 3.79-3.87 (m, 1H); 4.20 (dd, J=4.8, 6.3 Hz, 1H); 4.44 (dd, J=2.6, 4.6 Hz, 1H); 5.12 (d, J=4.6 Hz, 1H); 5.88 (d, J=6.3 Hz, 1H); 8.36 (s, 1H); 11.61 (s, 1H); 12.10 (s, 1H). 4f: $^1$H NMR (400 MHz, DMSO-$d_6$): δ 0.12 (s, 3H); 0.13 (s, 3H); 0.90 (s, 9H); 1.08 (d, J=6.4 Hz, 3H); 1.11 (d, J=6.8 Hz, 6H); 2.76 (septet, J=6.8 Hz, 1H); 3.25 (s, 3H); 3.66 (d, J=5.6 Hz, 1H); 3.76 (sextet, J=6.0 Hz, 1H); 4.36 (dd, J=4.6, 7.8 Hz, 1H); 4.54 (d, J=4.5 Hz, 1H); 5.16 (d, J=5.1 Hz, 1H); 5.83 (d, J=7.8 Hz, 1H); 8.32 (s, 1H); 11.60 (s, 1H); 12.10 (s, 1H).

c. Procedure for the Stereoselective Reaction of Purine 5'-Oxo-Nucleosides with Dimethylzinc.

N-Benzoyl-5'-(S)-C-methyl-3'-O-[(1,1-dimethylethyl)dimethylsilyl]-2'-O-methyl-adenosine 3e. A solution of crude aldehyde 2e, containing approximately 55% of the title compound (1.69 g, ≤3.4 mmol) in anhydrous DCM (10 mL) was slowly added dropwise for approximately 20 minutes to a stirred and cooled (−78° C.) mixture of ZnMe$_2$ (2 M in toluene, 6 mL, 12 mmol) and anhydrous DCM (10 mL) under argon atmosphere. The solution was allowed to slowly warm up (in bath) to room temperature overnight, cooled to 0° C., and quenched by cautious addition of 10% phosphoric acid. The organic phase was separated, washed with 5% brine, and dried over anhydrous sodium sulfate. The solvent was removed in vacuum and the crude residue (1.57 g) was purified by flash chromatography on a 40 g CombiFlash silica gel column with gradient (70 to 100%) of ethyl acetate in hexanes to afford 3e (0.96 g, 55%) in ~90% diastereomeric purity. The compound was dissolved in 5 mL of diethyl ether, and hexane (4 mL) was slowly added with stirring that triggered crystallization. The mixture was stirred at room temperature overnight, filtered and the solids were washed twice with ether-hexanes 1:2 mixture to afford 0.69 g (73% on crystallization) of 3e of ~97% diastereomeric purity.

N-Isobutyryl-5'-(S)-C-methyl-3'-O-[(1,1-dimethylethyl)dimethylsilyl]-2'-O-methyl-guanosine 3f was prepared analogously by addition of a solution of crude aldehyde 2f containing approximately 53% of the title compound (1.63 g, ≤3.4 mmol) in anhydrous DCM (10 mL) to a mixture of ZnMe$_2$ (2 M in toluene, 8.5 mL, 17 mmol) and anhydrous DCM (10 mL) at −78° C. under argon atmosphere, followed by slow (in bath) warming up to room temperature overnight. The crude residue (1.56 g) containing ~3:1 ratio of 3f to 4f was chromatographed over a silica gel flash-column (CombiFlash 40 g) with 2% of methanol in chloroform to afford 0.13 g of mixture of 4f and 3f followed by pure 3f 0.48 g (32%).

d. Stereospecific Interconversion of 5'-Alkyl-Epimers

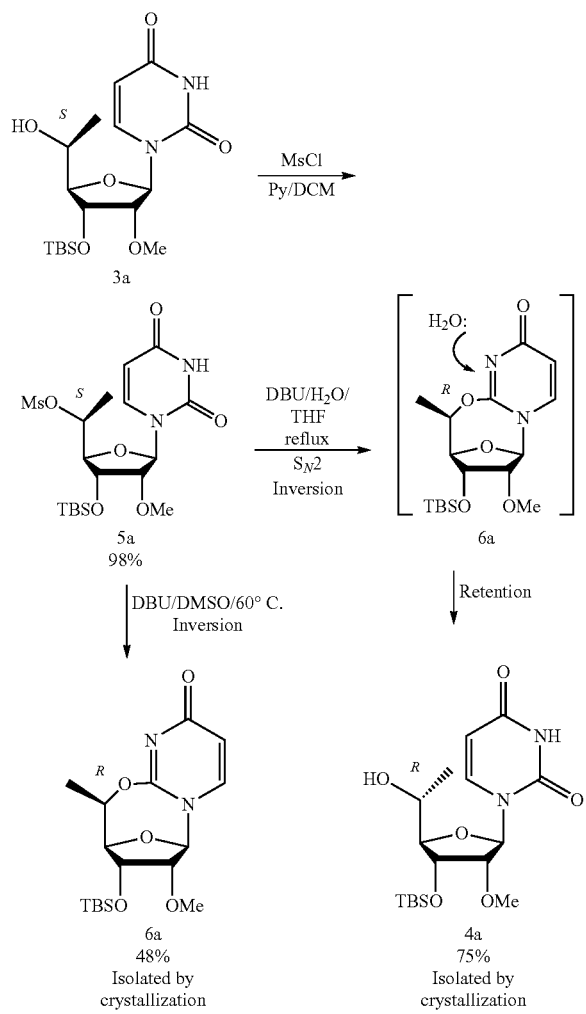

5'-(S)-C-Methyl-5'-O-mesyl-3'-O-[(1,1-dimethylethyl)dimethylsilyl]-2'-O-methyl-uridine 5a. Methanesulfonyl chloride (5.5 mL, 72 mmol) was added dropwise over a period of ~5 minutes to a cooled (0° C.) and stirred solution of (S)-epimer (3a) (8.32 g, 21.6 mmol) and anhydrous pyridine (5.8 mL, 72 mmol) in anhydrous DCM (80 mL) under argon atmosphere. The cooling bath was removed, the mixture was stirred at room temperature for 48 hours, cooled to 0° C., and quenched by careful addition of saturated solution of sodium bicarbonate (200 mL). The cooling bath was removed, the mixture was stirred vigorously at room temperature for 1 hour, the organic phase was separated, washed consecutively with 10% phosphoric acid, twice with 5% brine, and dried over anhydrous sodium sulfate. The solvent was removed in vacuum and the residue was dried under high vacuum to afford essentially pure 5a (9.79 g, 98%) as an orange foam. 5a: $^1$H NMR (400 MHz, DMSO-d$_6$): δ 0.09 (s, 3H); 0.10 (s, 3H); 0.87 (s, 9H); 1.42 (d, J=6.5 Hz, 3H); 3.20 (s, 3H); 3.33 (s, 3H); 3.86 (t, J=4.9 Hz, 1H); 3.89 (t, J=4.9 Hz, 1H); 4.29 (t, J=5.1 Hz, 1H); 4.91 (dt, J=6.4, 11.3 Hz, 1H); 5.68 (dd, J=2.2, 8.1 Hz, 1H); 5.86 (d, J=4.7 Hz, 1H); 7.65 (d, J=8.2 Hz, 1H); 11.42 (s, 1H).

6,9-Epoxy-2H,6H-pyrimido[2,1-b][1,3]oxazocin-2-one-7,8,10-trihydro-9-(R)-methyl-8-O-[(1,1-dimethylethyl)dimethylsilyl]-7-methoxy-[6R-(6α,7α,8α,9α)]6a. A solution of mesylate 5a (2.33 g, 5 mmol) and DBU (1.5 mL, 10 mmol) in anhydrous DMSO (10 mL) was stirred at 60° C. under argon atmosphere for 27 hours, cooled to 0° C., and ethyl acetate (40 mL) followed by 5% aqueous NaCl (80 mL) were added. The organic phase was separated, washed with a 1:1 mixture of 5% NaCl and 10% aqueous phosphoric acid, followed by 5% NaCl, saturated sodium bicarbonate, and saturated NaCl. After drying over anhydrous sodium sulfate, the solvent was removed in vacuum to afford crude anhydrous product 6a (1.57 g), that was refluxed with 30 mL of diethyl ether for 45 minutes, cooled to room temperature, stirred for 2 hours, the white precipitate was filtered, washed twice with diethyl ether and dried to afford 0.88 g (48%) of pure 6a. 6a: $^1$H NMR (400 MHz, DMSO-d$_6$): δ 0.06 (s, 3H); 0.7 (s, 3H); 0.84 (s, 9H); 1.36 (d, J=6.7 Hz, 3H); 3.29 (s, 3H); 4.13 (dd, J=0.8, 6.0 Hz, 1H); 4.27 (s, 1H); 4.32 (q, J=6.8 Hz, 1H); 4.62 (d, J=5.9 Hz, 1H); 5.78 (s, 1H); 5.89 (d, J=7.4 Hz, 1H); 7.95 (d, J=7.4 Hz, 1H). $^{13}$C NMR (126 MHz, DMSO-d$_6$): δ-5.22; -4.81; 16.79; 17.91; 25.59; 57.93; 71.42; 81.77; 86.33; 91.16; 96.24; 109.09; 142.58; 156.29; 170.67.

5'-(R)-C-Methyl-3'-O-[(1,1-dimethylethyl)dimethylsilyl]-2'-O-methyl-uridine 4a (from 5a). A solution of mesylate 5a (3.72 g, 8 mmol), DBU (2.4 mL, 16 mmol), and water (10 mL) in TI-IF (50 mL) was refluxed under argon atmosphere for 67 hours. The solvent was removed in vacuum, the residue was partitioned between ethyl acetate (120 mL) and a mixture of 80 mL of 5% NaCi and 30 mL of 1.0% phosphoric acid, the organic phase was separated, washed twice with 5% NaCl followed by saturated NaCl. After drying over anhydrous sodium sulfate, the crude residue (3.04 g) was refluxed with a. mixture of 30 mL of diethyl ether and 15 mL of hexanes for 1 hour, cooled to room temperature, stirred overnight, the white precipitate was filtered, and washed twice with ether-hexanes 1:1 mixture to afford 2.32 g (75%) of 4a.

The process described in this example can be used for the synthesis of various 5'-alkyl nucleosides for any therapeutic applications (e.g., antiviral, and antitumor applications), including oligonucleotide and small molecules.

Example 9: Steric Blocking of Phosphodiester (PO), Phosphorothioate (PS) and Phosphorodithioate (PS$_2$) by Introducing 4' and 5'-Modified Nucleotide to the 3'-End of PO, PS, or PS$_2$ Linkage The inventors found that introducing a 4'-modified and/or 5'-modified nucleotide to the 3'-end of a phosphodiester (PO), phosphorothioate (PS), and/or phosphorodithioate (PS₂) linkage of a dinucleotide at any position of single stranded or double stranded oligonucleotide can exert steric effect to the internucleotide linkage and, hence, protecting or stabilizing it against nucleases.

In this example, in vitro gene silencing activity of F7 siRNA containing 4'-O-methylated or 5'-methylated nucleotides at selected position were evaluated, and the results are shown in Table 11.

TABLE 11 in vitro gene silencing activity of F7 siRNA containing 4'-O-methylated or 5'-methylated nucleotides at selected position (Table 11 discloses SEQ ID NOS 233-274, respectively, in order of columns)

| Duplex ID | Sense | Antisense | 10 nM vg | 10 nM D | 0.1 nM vg | 0.1 nM D |
|---|---|---|---|---|---|---|
| D-60347 | CfsasGfgAfuCfaUfCfUfcAfaGfuCfUfaCfL96 | gsUfsaAfgAfcUfuGfagaUfgAfuCfcUfgsgsc | 3.2 | .9 | 1.4 | .2 |
| D-63931 | CfsasGfgAfuCfaUfCfUfcAfaGfuCfUUfaAfL96 | usUfsaAfgAfcUfuGfagaUfgAfuCfcUfgsgsc | .7 | .7 | 1.2 | .7 |
| D-69122 | CfsasGfgAfuCfaUfCfUfcAfaGfuCfU(Ufm)aAfL96 | usUfsaAfgAfcUfuGfagaUfgAfuCfcUfgsgsc | .9 | .7 | 1.7 | .7 |
| D-69123 | CfsasGfgAfuCfaUfCfUfcAfaGfuCfU(UfmR)aAfL96 | usUfsaAfgAfcUfuGfagaUfgAfuCfcUfgsgsc | .4 | .9 | 0.6 | .5 |
| D-69124 | CfsasGfgAfuCfaUfCfUfcAfaGfuCfU(u5m)aAfL96 | usUfsaAfgAfcUfuGfagaUfgAfuCfcUfgsgsc | .4 | .1 | 3.9 | .0 |
| D-69125 | CfsasGfgAfuCfaUfCfUfcAfaGfuCfU(u5mR)aAfL96 | usUfsaAfgAfcUfuGfagaUfgAfuCfcUfgsgsc | .5 | .6 | 5.1 | .0 |
| D-69126 | CfsasGfgAfuCfaUfCfUfcAfaGfuCfU(T5m)aAfL96 | usUfsaAfgAfcUfuGfagaUfgAfuCfcUfgsgsc | .9 | .4 | 0.7 | .9 |
| D-69127 | CfsasGfgAfuCfaUfCfUfcAfaGfuCfU(T5mR)aAfL96 | usUfsaAfgAfcUfuGfagaUfgAfuCfcUfgsgsc | .5 | .5 | 4.0 | .5 |
| D-69128 | CfsasGfgAfuCfaUfCfUfcAfaGfuCfU(Ufo)aAfL96 | usUfsaAfgAfcUfuGfagaUfgAfuCfcUfgsgsc | .6 | .3 | 0.4 | .1 |
| D-69129 | CfsasGfgAfuCfaUfCfUfcAfaGfuCfU(dTo)aAfL96 | usUfsaAfgAfcUfuGfagaUfgAfuCfcUfgsgsc | .3 | .2 | 0.9 | .3 |
| D-69130 | CfsasGfgAfuCfaUfCfUfcAfaGfuCfUuaAfL96 | usUfsaAfgAfcUfuGfagaUfgAfuCfcUfgsgsc | .6 | .7 | 1.6 | .5 |
| D-69131 | CfsasGfgAfuCfaUfCfUfcAfaGfuCfUdTaAfL96 | usUfsaAfgAfcUfuGfagaUfgAfuCfcUfgsgsc | .7 | .3 | 4.8 | .1 |
| D-63934 | CfsasGfgAfuCfaUfCfUfcAfaGfuCfuUfaAfL96 | usUfsaAfgAfcUfuGfagaUfgAfUCfcUfgsgsc | .2 | .7 | 9.2 | .4 |
| D-69132 | CfsasGfgAfuCfaUfCfUfcAfaGfuCfuUfaAfL96 | usUfsaAfgAfcUfuGfagaUfgAfU(Cfm)cUfgsgsc | .9 | .2 | 7.7 | .1 |
| D-69133 | CfsasGfgAfuCfaUfCfUfcAfaGfuCfuUfaAfL96 | usUfsaAfgAfcUfuGfagaUfgAfU(CfmR)cUfgsgsc | .5 | .9 | 8.2 | .1 |
| D-69134 | CfsasGfgAfuCfaUfCfUfcAfaGfuCfuUfaAfL96 | usUfsaAfgAfcUfuGfagaUfgAfU(c5m)cUfgsgsc | .4 | .7 | 3.1 | .7 |
| D-69135 | CfsasGfgAfuCfaUfCfUfcAfaGfuCfuUfaAfL96 | usUfsaAfgAfcUfuGfagaUfgAfU(c5mR)cUfgsgsc | .5 | .8 | 7.8 | .2 |
| D-69136 | CfsasGfgAfuCfaUfCfUfcAfaGfuCfuUfaAfL96 | usUfsaAfgAfcUfuGfagaUfgAfU(Cfo)cUfgsgsc | .5 | .8 | 5.3 | .1 |
| D-69137 | CfsasGfgAfuCfaUfCfUfcAfaGfuCfuUfaAfL96 | usUfsaAfgAfcUfuGfagaUfgAfU(dCo)cUfgsgsc | .1 | .4 | 8.6 | .9 |
| D-69138 | CfsasGfgAfuCfaUfCfUfcAfaGfuCfuUfaAfL96 | usUfsaAfgAfcUfuGfagaUfgAfUccUfgsgsc | .1 | .8 | 8.9 | .9 |
| D-69139 | CfsasGfgAfuCfaUfCfUfcAfaGfuCfuUfaAfL96 | usUfsaAfgAfcUfuGfagaUfgAfUdTcUfgsgsc | .1 | .6 | 9.6 | .1 |

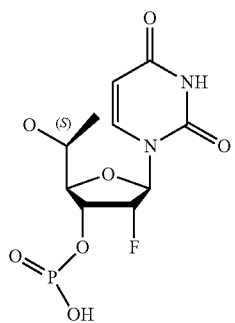

2'-fluoro-5'-(S)-methyl-uridine-
3'-phosphate (Ufm)

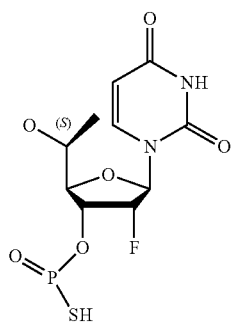

2'-fluoro-5'-(S)-methyl-uridine-
3'-phosphorothioate (Ufms)

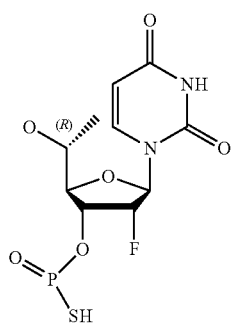

2'-fluoro-5'-(R)-methyl-uridine-
3'-phosphorothioate (UfmRs)

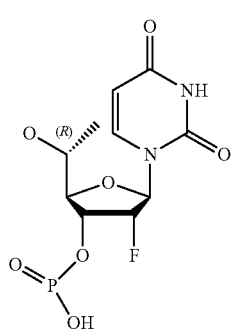

2'-fluoro-5'-(R)-methyl-uridine-
3'-phosphate (UfmR)

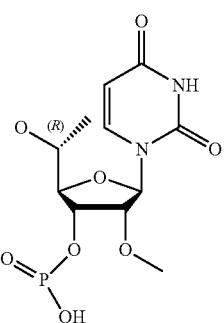

2'-O-methyl-5'-(R)-methyl-
uridine-3'-phosphate (u5mR)

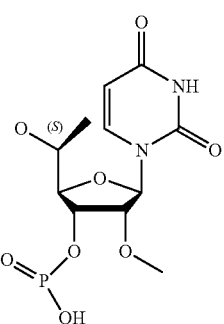

2'-O-methyl-5'-(S)-methyl-
uridine-3'-phosphate (u5m)

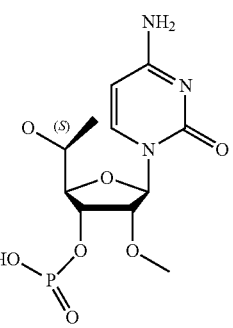

2'-O-methyl-5'-(S)-methyl-
cytidine-3'-phosphate (c5m)

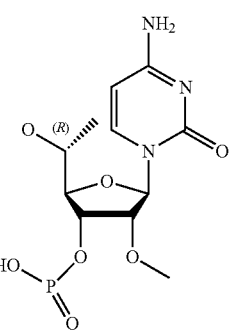

2'-O-methyl-5'-(R)-methyl-
cytidine-3'-phosphate (c5mR)

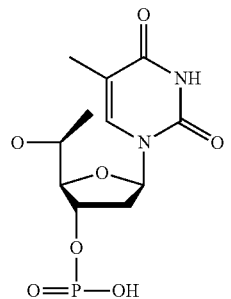

5'-(S)-methyl-deoxythymidine-
3'-phosphate (T5m)

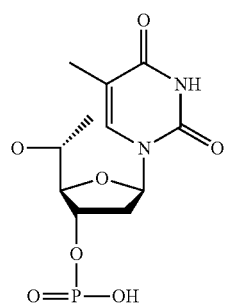

5'-(R)-methyl-deoxythymidine-
3'-phosphate (T5mR)

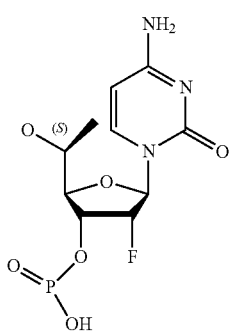

2'-fluoro-5'-(S)-methyl-
cytosine-3'-phosphate (Cfm)

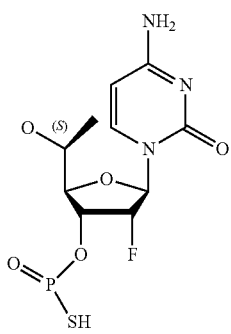

2'-fluoro-5'-(S)-methyl-
cytosine-3'-phosphorothioate
(Cfms)

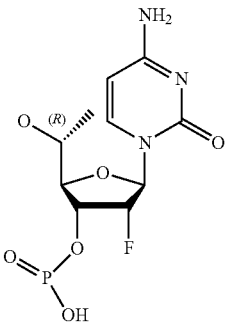

2'-fluoro-5'-(R)-methyl-
cytosine-3'-phosphate (CfmR)

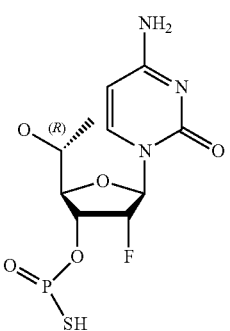

2'-fluoro-5'-(R)-methyl-
cytosine-3'-phosphorothioate
(CfmRs)

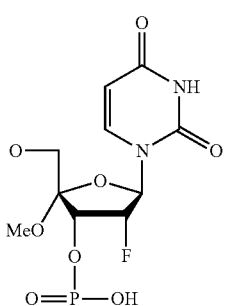

2'-fluoro-4'-methoxyuridine-
3'-phosphate ((Ufo)

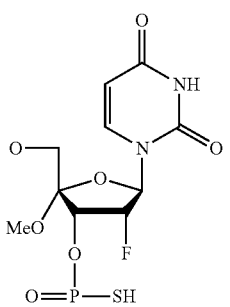

2'-fluoro-4'-methoxyuridine-
3'-phosphorothioate (Ufos)

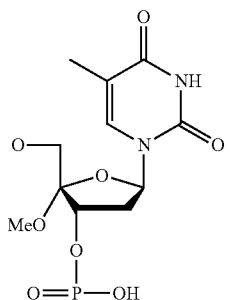

4'-methoxy-2'-deoxythymidine-
3'-phosphate (dTo)

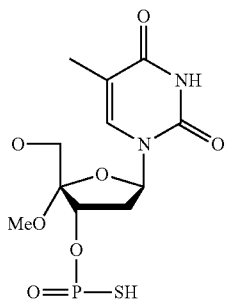

4'-methoxy-2'-
deoxythymidine-3'-
phosphorothioate (dTos)

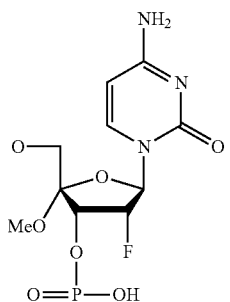

2'-fluoro-4'-methoxycytidine-
3'-phosphate (Cfo)

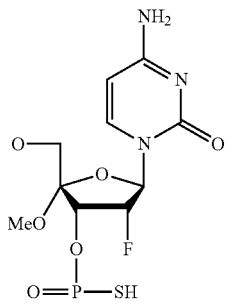

2'-fluoro-4'-methoxycytidine-
3'-phosphorothioate (Cfos)

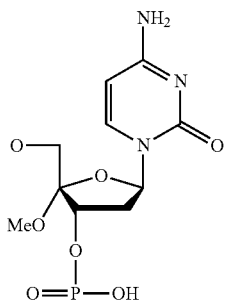

4'-methoxy-2'-deoxycytidine-
3'-phosphate (dCo)

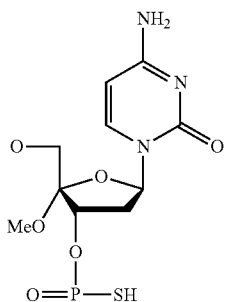

4'-methoxy-2'-deoxycytidine-
3'-phosphorothioate (dCos)

Example 10: Chirality-Dependent Activity of Glycol Nucleic Acid (GNA) in siRNA Duplexes Chemical modifications of siRNA duplexes are necessary to stabilize these molecules against nuclease degradation, to facilitate their uptake into cells, and to affect formation of active RISC as well as RNAi-mediated target silencing. Thermally destabilizing modifications incorporated at certain positions of the siRNA duplex can lead to an increase in potency by improving strand bias and/or sense strand dissociation during RISC loading.

In this example, a three-carbon, acyclic nucleic acid analog, Glycol Nucleic Acid (GNA) was evaluated within the context of siRNA duplexes. GNA-containing siRNA duplexes were synthesized. (S)-GNA oligomers formed homo-duplexes with structural similarities to a typical RNA A-form duplex and crosspair with RNA, but not DNA, within A/T-rich sequences. The thermal stabilities and nuclease resistance of siRNA duplexes containing (S)- or (R)-GNA were investigated. Structural studies using x-ray crystallography provided further insight into the effect of these GNA substituents within RNA duplexes. Chirality-dependent gene silencing activity of GNA-containing siRNA duplexes was examined in biological studies.

The table below discloses SEQ ID NOS 275-366, respectively, in order of columns.

| Duplex ID | Sense (5' to 3') | Antisense (5' to 3') | Design |
|---|---|---|---|
| AD-57727.66 | AfsasCfaGfuGfuCfUfuGfcUfcUfaUfaAfL96 | usUfsaUfaGfaGfcAfagaAfcAfcUfgUfususu | Parent |
| AD-68368.2 | AfsasCfaGfuGfuCfUfuGfcUfcUfaUfaAfL96 | (Tgns)UfsaUfaGfaGfcAfagaAfcAfcUfgUfususu | AS: gN @ N1 |
| AD-62896.4 | AfsasCfaGfuGfuCfUfuGfcUfcUfaUfaAfL96 | P(Tgns)UfsaUfaGfaGfcAfagaAfcAfcUfgUfususu | 5'-p, gN @ N2 |
| AD-68369.2 | AfsasCfaGfuGfuCfUfuGfcUfcUfaUfaAfL96 | us(Tgns)aUfaGfaGfcAfagaAfcAfcUfgUfususu | AS: gN @ N2 |
| AD-68370.2 | AfsasCfaGfuGfuCfUfuGfcUfcUfaUfaAfL96 | usUfs(Agn)UfaGfaGfcAfagaAfcAfcUfgUfususu | AS: gN @ N3 |
| AD-68371.2 | AfsasCfaGfuGfuCfUfuGfcUfcUfaUfaAfL96 | usUfsa(Tgn)aGfaGfcAfagaAfcAfcUfgUfususu | AS: gN @ N4 |
| AD-68372.2 | AfsasCfaGfuGfuCfUfuGfcUfcUfaUfaAfL96 | usUfsaUf(Agn)GfaGfcAfagaAfcAfcUfgUfususu | AS: gN @ N5 |
| AD-68373.2 | AfsasCfaGfuGfuCfUfuGfcUfcUfaUfaAfL96 | usUfsaUfa(Ggn)aGfcAfagaAfcAfcUfgUfususu | AS: gN @ N6 |
| AD-68374.2 | AfsasCfaGfuGfuCfUfuGfcUfcUfaUfaAfL96 | usUfsaUfaGf(Agn)GfcAfagaAfcAfcUfgUfususu | AS: gN @ N7 |
| AD-68375.2 | AfsasCfaGfuGfuCfUfuGfcUfcUfaUfaAfL96 | usUfsaUfaGfa(Ggn)cAfagaAfcAfcUfgUfususu | AS: gN @ N8 |
| AD-68376.2 | AfsasCfaGfuGfuCfUfuGfcUfcUfaUfaAfL96 | usUfsaUfaGfaGf(Cgn)AfagaAfcAfcUfgUfususu | AS: gN @ N9 |
| AD-68377.2 | AfsasCfaGfuGfuCfUfuGfcUfcUfaUfaAfL96 | usUfsaUfaGfaGfc(Agn)agaAfcAfcUfgUfususu | AS: gN @ N10 |
| AD-68378.2 | AfsasCfaGfuGfuCfUfuGfcUfcUfaUfaAfL96 | usUfsaUfaGfaGfcAf(Agn)gaAfcAfcUfgUfususu | AS: gN @ N11 |
| AD-68379.2 | AfsasCfaGfuGfuCfUfuGfcUfcUfaUfaAfL96 | usUfsaUfaGfaGfcAfa(Ggn)aAfcAfcUfgUfususu | AS: gN @ N12 |
| AD-68380.2 | AfsasCfaGfuGfuCfUfuGfcUfcUfaUfaAfL96 | usUfsaUfaGfaGfcAfag(Agn)AfcAfcUfgUfususu | AS: gN @ N13 |
| AD-68381.2 | AfsasCfaGfuGfuCfUfuGfcUfcUfaUfaAfL96 | usUfsaUfaGfaGfcAfaga(Agn)cAfcUfgUfususu | AS: gN @ N14 |
| AD-68382.2 | AfsasCfaGfuGfuCfUfuGfcUfcUfaUfaAfL96 | usUfsaUfaGfaGfcAfagaAf(Cgn)AfcUfgUfususu | AS: gN @ N15 |
| AD-68383.2 | AfsasCfaGfuGfuCfUfuGfcUfcUfaUfaAfL96 | usUfsaUfaGfaGfcAfagaAfc(Agn)cUfgUfususu | AS: gN @ N16 |
| AD-68384.2 | AfsasCfaGfuGfuCfUfuGfcUfcUfaUfaAfL96 | usUfsaUfaGfaGfcAfagaAfcAf(Cgn)UfgUfususu | AS: gN @ N17 |
| AD-68385.2 | AfsasCfaGfuGfuCfUfuGfcUfcUfaUfaAfL96 | usUfsaUfaGfaGfcAfagaAfcAfc(Tgn)gUfususu | AS: gN @ N18 |
| AD-68386.2 | AfsasCfaGfuGfuCfUfuGfcUfcUfaUfaAfL96 | usUfsaUfaGfaGfcAfagaAfcAfcUf(Ggn)Ufususu | AS: gN @ N19 |
| AD-68387.2 | AfsasCfaGfuGfuCfUfuGfcUfcUfaUfaAfL96 | usUfsaUfaGfaGfcAfagaAfcAfcUfg(Tgn)ususu | AS: gN @ N20 |
| AD-68388.2 | AfsasCfaGfuGfuCfUfuGfcUfcUfaUfaAfL96 | usUfsaUfaGfaGfcAfagaAfcAfcUfgUf(Tgns)usu | AS: gN @ N21 |
| AD-68389.2 | AfsasCfaGfuGfuCfUfuGfcUfcUfaUfaAfL96 | usUfsaUfaGfaGfcAfagaAfcAfcUfgUfus(Tgns)u | AS: gN @ N22 |
| AD-68390.2 | AfsasCfaGfuGfuCfUfuGfcUfcUfaUfaAfL96 | usUfsaUfaGfaGfcAfagaAfcAfcUfgUfusus(Tgn) | AS: gN @ N23 |

-continued

| Duplex ID | Sense (5' to 3') | Antisense (5' to 3') | Design |
|---|---|---|---|
| AD-68391.2 | (Agns)asCfaGfuGfuUfCfUfuGfcUfcUfaUfaAfL96 | usUfsaUfaGfaGfcAfagaAfcAfcUfgUfususu | S: gN @ N1 |
| AD-68392.2 | Afs(Agns)CfaGfuUfCfUfuGfcUfcUfaUfaAfL96 | usUfsaUfaGfaGfcAfagaAfcAfcUfgUfususu | S: gN @ N2 |
| AD-68393.2 | Afsas(Cgn)aGfuGfuUfCfUfuGfcUfcUfaUfaAfL96 | usUfsaUfaGfaGfcAfagaAfcAfcUfgUfususu | S: gN @ N3 |
| AD-68394.2 | AfsasCf(Agn)GfuGfuUfCfUfuGfcUfcUfaUfaAfL96 | usUfsaUfaGfaGfcAfagaAfcAfcUfgUfususu | S: gN @ N4 |
| AD-68395.2 | AfsasCfa(Ggn)uGfuUfCfUfuGfcUfcUfaUfaAfL96 | usUfsaUfaGfaGfcAfagaAfcAfcUfgUfususu | S: gN @ N5 |
| AD-68396.2 | AfsasCfaGf(Tgn)GfuUfCfUfuGfcUfcUfaUfaAfL96 | usUfsaUfaGfaGfcAfagaAfcAfcUfgUfususu | S: gN @ N6 |
| AD-68397.2 | AfsasCfaGfu(Ggn)uUfCfUfuGfcUfcUfaUfaAfL96 | usUfsaUfaGfaGfcAfagaAfcAfcUfgUfususu | S: gN @ N7 |
| AD-68398.2 | AfsasCfaGfuGf(Tgn)UfCfUfuGfcUfcUfaUfaAfL96 | usUfsaUfaGfaGfcAfagaAfcAfcUfgUfususu | S: gN @ N8 |
| AD-68399.2 | AfsasCfaGfuGfu(Tgn)CfUfuGfcUfcUfaUfaAfL96 | usUfsaUfaGfaGfcAfagaAfcAfcUfgUfususu | S: gN @ N9 |
| AD-68400.2 | AfsasCfaGfuGfuUf(Cgn)UfuGfcUfcUfaUfaAfL96 | usUfsaUfaGfaGfcAfagaAfcAfcUfgUfususu | S: gN @ N10 |
| AD-62900.1 | AfsasCfaGfuGfuUfCf(Tgn)uGfcUfcUfaUfaAfL96 | usUfsaUfaGfaGfcAfagaAfcAfcUfgUfususu | S: gN @ N11 |
| AD-68401.2 | AfsasCfaGfuGfuUfCfUf(Tgn)GfcUfcUfaUfaAfL96 | usUfsaUfaGfaGfcAfagaAfcAfcUfgUfususu | S: gN @ N12 |
| AD-68402.2 | AfsasCfaGfuGfuUfCfUfu(Ggn)cUfcUfaUfaAfL96 | usUfsaUfaGfaGfcAfagaAfcAfcUfgUfususu | S: gN @ N13 |
| AD-68403.2 | AfsasCfaGfuGfuUfCfUfuGf(Cgn)UfcUfaUfaAfL96 | usUfsaUfaGfaGfcAfagaAfcAfcUfgUfususu | S: gN @ N14 |
| AD-68404.2 | AfsasCfaGfuGfuUfCfUfuGfc(Tgn)cUfaUfaAfL96 | usUfsaUfaGfaGfcAfagaAfcAfcUfgUfususu | S: gN @ N15 |
| AD-68405.2 | AfsasCfaGfuGfuUfCfUfuGfcUf(Cgn)UfaUfaAfL96 | usUfsaUfaGfaGfcAfagaAfcAfcUfgUfususu | S: gN @ N16 |
| AD-68406.2 | AfsasCfaGfuGfuUfCfUfuGfcUfc(Tgn)aUfaAfL96 | usUfsaUfaGfaGfcAfagaAfcAfcUfgUfususu | S: gN @ N17 |
| AD-68407.2 | AfsasCfaGfuGfuUfCfUfuGfcUfcUf(Agn)UfaAfL96 | usUfsaUfaGfaGfcAfagaAfcAfcUfgUfususu | S: gN @ N18 |
| AD-68408.2 | AfsasCfaGfuGfuUfCfUfuGfcUfcUfa(Tgn)aAfL96 | usUfsaUfaGfaGfcAfagaAfcAfcUfgUfususu | S: gN @ N19 |
| AD-68409.2 | AfsasCfaGfuGfuUfCfUfuGfcUfcUfaUf(Agn)AfL96 | usUfsaUfaGfaGfcAfagaAfcAfcUfgUfususu | S: gN @ N20 |
| AD-68410.2 | AfsasCfaGfuGfuUfCfUfuGfcUfcUfaUfa(Agn)L96 | usUfsaUfaGfaGfcAfagaAfcAfcUfgUfususu | S: gN @ N21 |

The table below discloses SEQ ID NOS 367-456. respectively, in order of columns.

| Duplex ID | Sense (5' to 3') | Antisense (5' to 3') | Design |
|---|---|---|---|
| AD-57727.66 | AfsasCfaGfuGfuCfUfuGfcUfcUfaUfaAfL96 | usUfsaUfaGfaGfcAfagaAfcAfcUfgUfususu | Parent |
| AD-69078.1 | AfsasCfaGfuGfuCfUfuGfcUfcUfaUfa(Agn)L96 | (Tgns)UfsaUfaGfaGfcAfagaAfcAfcUfgUfususu | AS: gN @ N1;<br>S: gN @ N21 |
| AD-69079.1 | AfsasCfaGfuGfuCfUfuGfcUfcUfaUf(Agn)AfL96 | us(Tgns)aUfaGfaGfcAfagaAfcAfcUfgUfususu | AS: gN @ N2;<br>S: gN @ N20 |
| AD-69080.1 | AfsasCfaGfuGfuCfUfuGfcUfcUfa(Tgn)aAfL96 | usUfs(Agn)UfaGfaGfcAfagaAfcAfcUfgUfususu | AS: gN @ N3;<br>S: gN @ N19 |
| AD-69081.1 | AfsasCfaGfuGfuCfUfuGfcUfcUf(Agn)UfaAfL96 | usUfsa(Tgn)aGfaGfcAfagaAfcAfcUfgUfususu | AS: gN @ N4;<br>S: gN @ N18 |
| AD-69082.1 | AfsasCfaGfuGfuCfUfuGfcUfc(Tgn)aUfaAfL96 | usUfsaUf(Agn)GfaGfcAfagaAfcAfcUfgUfususu | AS: gN @ N5;<br>S: gN @ N17 |
| AD-69083.1 | AfsasCfaGfuGfuCfUfuGfcUf(Cgn)UfaUfaAfL96 | usUfsaUfa(Ggn)aGfcAfagaAfcAfcUfgUfususu | AS: gN @ N6;<br>S: gN @ N16 |
| AD-69084.1 | AfsasCfaGfuGfuCfUfuGfcUf(Tgn)cUfaUfaAfL96 | usUfsaUfaGf(Agn)cAfagaAfcAfcUfgUfususu | AS: gN @ N7;<br>S: gN @ N15 |
| AD-69085.1 | AfsasCfaGfuGfuCfUfuGf(Cgn)UfcUfaUfaAfL96 | usUfsaUfaGfa(Ggn)cAfagaAfcAfcUfgUfususu | AS: gN @ N8;<br>S: gN @ N14 |
| AD-69086.1 | AfsasCfaGfuGfuCfUfuGf(Tgn)fcUfcUfaUfaAfL96 | usUfsaUfaGfaGf(Agn)AfagaAfcAfcUfgUfususu | AS: gN @ N9;<br>S: gN @ N13 |
| AD-69087.1 | AfsasCfaGfuGfuCfUfu(Ggn)cUfcUfaUfaAfL96 | usUfsaUfaGfaGfc(Agn)agaAfcAfcUfgUfususu | AS: gN @ N10;<br>S: gN @ N12 |
| AD-69088.1 | AfsasCfaGfuGfuCfUfuGfcUfcUf(Tgn)uGfcUfcUfaUfaAfL96 | usUfsaUfaGfaGfcAf(Agn)gaAfcAfcUfgUfususu | AS: gN @ N11;<br>S: gN @ N11 |
| AD-69089.1 | AfsasCfaGfuGfuCfUf(Cgn)UfuGfcUfcUfaUfaAfL96 | usUfsaUfaGfaGfcAfa(Ggn)aAfcAfcUfgUfususu | AS: gN @ N12;<br>S: gN @ N10 |
| AD-69090.1 | AfsasCfaGfuGfu(Tgn)CfUfuGfcUfcUfaUfaAfL96 | usUfsaUfaGfaGfcAfag(Agn)AfcAfcUfgUfususu | AS: gN @ N13;<br>S: gN @ N9 |
| AD-69091.1 | AfsasCfaGfuGf(Tgn)UfCfUfuGfcUfcUfaUfaAfL96 | usUfsaUfaGfaGfcAfaga(Agn)cAfcUfgUfususu | AS: gN @ N14;<br>S: gN @ N8 |
| AD-69092.1 | AfsasCfaGfu(Ggn)uUfCfuGfcUfcUfaUfaAfL96 | usUfsaUfaGfaGfcAfagaAf(Cgn)AfcUfgUfususu | AS: gN @ N15;<br>S: gN @ N7 |
| AD-69093.1 | AfsasCfaGf(Tgn)GfuUfCfUfuGfcUfcUfaUfaAfL96 | usUfsaUfaGfaGfcAfagaAfc(Agn)cUfgUfususu | AS: gN @ N16;<br>S: gN @ N6 |

| Duplex ID | Sense (5' to 3') | Antisense (5' to 3') | Design |
|---|---|---|---|
| AD-69094.1 | AfsasCfa(Ggn)uGfuUfcFuFuGfcUfcUfaUfaAfL96 | usUfsaUfaGfaGfcAfagaAfcAf(Cgn)UfgUfususu | AS: gN @ N17; S: gN @ N5 |
| AD-69095.1 | AfsasCf(Agn)GfuGfuUfCfUfuGfcUfcUfaUfaAfL96 | usUfsaUfaGfaGfcAfagaAfcAfc(Tgn)gUfususu | AS: gN @ N18; S: gN @ N4 |
| AD-69096.1 | Afsas(Cgn)aGfuGfuUfCfUfuGfcUfcUfaUfaAfL96 | usUfsaUfaGfaGfcAfagaAfcAfcUf(Ggn)Ufususu | AS: gN @ N19; S: gN @ N3 |
| AD-69097.1 | Afs(Agns)CfaGfuGfuUfCfUfuGfcUfcUfaUfaAfL96 | usUfsaUfaGfaGfcAfagaAfcAfcUfg(Tgn)ususu | AS: gN @ N20; S: gN @ N2 |
| AD-69098.1 | (Agns)asCfaGfuGfuUfCfUfuGfcUfcUfaUfaAfL96 | usUfsaUfaGfaGfcAfagaAfcAfcUfgUf(Tgns)usu | AS: gN @ N21; S: gN @ N1 |
| AD-69099.1 | AfsasCfaGfuGfuUfCfUfuGfcUfcUfaUfaAfL96 | usUfsaUfa(Ggn)aGfcAfagaAfcAfcUfgUfususu | AS: gN @ N6; S: gN @ N15 |
| AD-69100.1 | AfsasCfaGfuGfuUfCfUfuGfcUfc(Tgn)aUfaAfL96 | usUfsaUfa(Cgn)aGfcAfagaAfcAfcUfgUfususu | AS: gN @ N6; S: gN @ N17 |
| AD-69101.1 | AfsasCfaGfuGfuUfCfUfuGfcUfcUfc(Cgn)UfaAfL96 | usUfsaUfa(Agn)aGfcAfagaAfcAfcUfgUfususu | AS: gN @ N7; S: gN @ N16 |
| AD-69102.1 | AfsasCfaGfuGfuUfCfUfuGfcUfcUfc(Tgn)aUfaAfL96 | usUfsaUfaGf(Agn)GfcAfagaAfcAfcUfgUfususu | AS: gN @ N7; S: gN @ N17 |
| AD-69103.1 | AfsasCfaGfuGfuUfCfUfuGfcUfcUfcUfc(Tgn)UfaAfL96 | usUfs(Agn)UfaGfaGfcAfagaAfcAfcUfgUfususu | AS: gN @ N3; S: gN @ N15 |
| AD-69104.1 | AfsasCfaGfuGfuUfCfUfuGfcUfcUfc(Cgn)UfaAfL96 | usUfs(Agn)UfaGfaGfcAfagaAfcAfcUfgUfususu | AS: gN @ N3; S: gN @ N16 |
| AD-69105.1 | AfsasCfaGfuGfuUfCfUfuGfcUfc(Tgn)aUfaAfL96 | usUfs(Agn)UfaGfaGfcAfagaAfcAfcUfgUfususu | AS: gN @ N3; S: gN @ N17 |
| AD-69106.1 | AfsasCfaGfuGfuUfCfUfuGfcUfc(Cgn)UfaAfL96 | usUfsaUfaGfa(Ggn)cAfagaAfcAfcUfgUfususu | AS: gN @ N8; S: gN @ N15 |
| AD-69107.1 | AfsasCfaGfuGfuUfCfUfuGfcUfcUf(Cgn)UfaAfL96 | usUfsaUfaGfa(Ggn)cAfagaAfcAfcUfgUfususu | AS: gN @ N8; S: gN @ N16 |
| AD-69108.1 | AfsasCfaGfuGfuUfCfUfuGfcUfc(Tgn)aUfaAfL96 | usUfsaUfaGfa(Ggn)cAfagaAfcAfcUfgUfususu | AS: gN @ N8; S: gN @ N17 |
| AD-69109.1 | Afs(Agns)CfaGfuGfuUfCfUfuGfcUfcUfcUfaUfaAfL96 | usUfsaUfa(Ggn)aGfcAfagaAfcAfcUfgUfususu | AS: gN @ N6; S: gN @ N2 |
| AD-69110.1 | Afs(Agns)CfaGfuGfuUfCfUfuGfcUfcUfcUfaUfaAfL96 | usUfsaUfaGf(Agn)GfcAfagaAfcAfcUfgUfususu | AS: gN @ N7; S: gN @ N2 |

-continued

| Duplex ID | Sense (5' to 3') | Antisense (5' to 3') | Design |
|---|---|---|---|
| AD-69111.1 | AfsasCfaGf(Tgn)GfuUfCfUfuGfcUfcUfaUfaAfL96 | usUfsaUfa(Ggn)aGfcAfagaAfcAfcUfgUfususu | AS: gN @ N6; S: gN @ N6 |
| AD-69112.1 | AfsasCfaGf(Tgn)GfuUfCfUfuGfcUfcUfaUfaAfL96 | usUfsaUfaGf(Agn)GfcAfagaAfcAfcUfgUfususu | AS: gN @ N7; S: gN @ N6 |
| AD-69113.1 | AfsasCfaGfu(Ggn)uUfCfUfuGfcUfcUfaUfaAfL96 | usUfsaUfa(Ggn)aGfcAfagaAfcAfcUfgUfususu | AS: gN @ N6; S: gN @ N7 |
| AD-69114.1 | AfsasCfaGfu(Ggn)uUfCfUfuGfcUfcUfaUfaAfL96 | usUfsaUfaGf(Agn)GfcAfagaAfcAfcUfgUfususu | AS: gN @ N7; S: gN @N7 |
| AD-69115.1 | AfsasCfaGfuGfuUfCfUfuGfcUfcUfaUfa(Agn)L96 | usUfsaUfa(Ggn)aGfcAfagaAfcAfcUfgUfususu | AS: gN @ N6; S: gN @ N21 |
| AD-69116.1 | AfsasCfaGfuGfuUfCfUfuGfcUfcUfaUfa(Agn)L96 | usUfsaUfaGf(Agn)GfcAfagaAfcAfcUfgUfususu | AS: gN @ N7; S: gN @ N21 |
| AD-69117.1 | AfsasCfaGfuGfuUfCfUfuGfcUfcUfaUfaAfL96 | us(Tgns)aUfaGfaGfcAfagaAfcAfcUfgUfususu | AS: gN @ N2; S: gN @ N11 |
| AD-69118.1 | AfsasCfaGfuGfuUfCfUfUf(Tgn)GfcUfcUfaUfaAfL96 | us(Tgns)aUfaGfaGfcAfagaAfcAfcUfgUfususu | AS: gN @ N2; S: gN @ N12 |
| AD-69119.1 | AfsasCfaGfuGfuUfCfUfuGfcUfcUfaUfaAfL96 | usUfsaUfa(Ggn)aGfcAfagaAfcAfcUfgUfususu | AS: gN @ N6; S: gN @ N11 |
| AD-69120.1 | AfsasCfaGfuGfuUfCfUfUf(Tgn)uGfcUfcUfaUfaAfL96 | usUfsaUfaGf(Agn)GfcAfagaAfcAfcUfgUfususu | AS: gN @ N7; S: gN @ N11 |
| AD-69121.1 | AfsasCfaGfuGfuUfCfUfUfuGf(Cgn)UfaUfaAfL96 | us(Tgns)aUfaGfaGfcAfagaAfcAfcUfgUfususu | AS: gN @ N2; S: gN @ N16 |

The results are shown in FIGS. 27-30.

Figure 27:
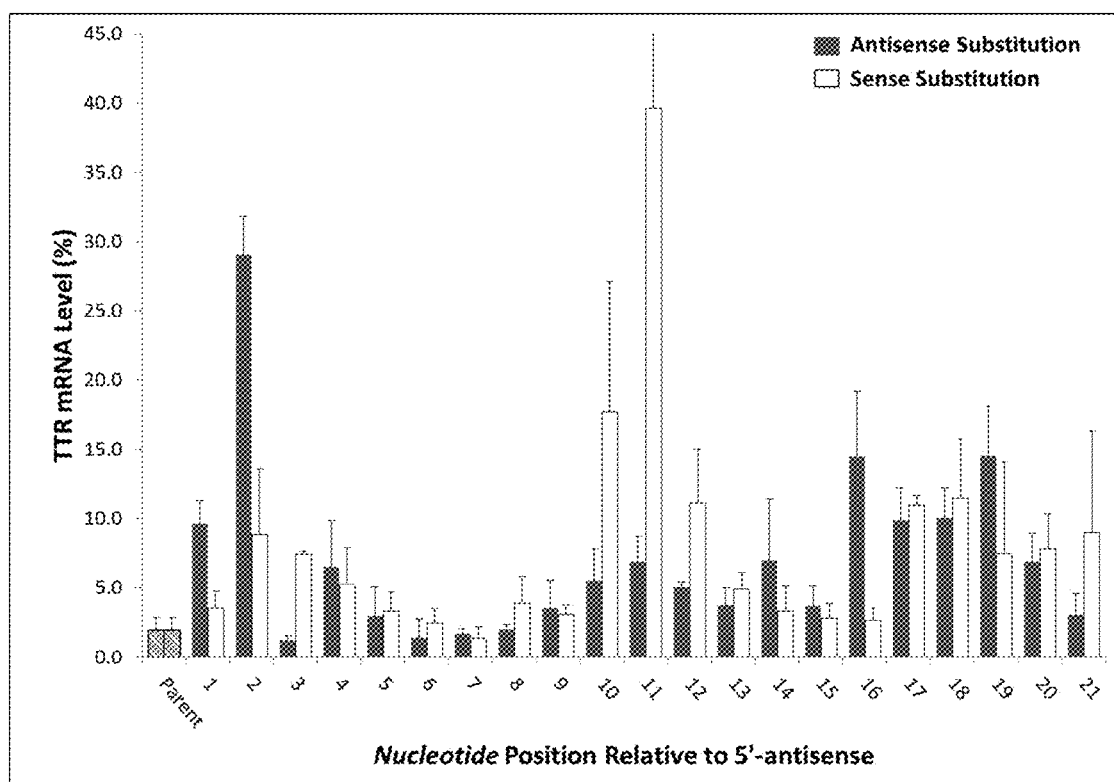
FIG. 27 is a graph showing the in vitro knockdown of TTR using siRNA modified with a single (S)-GNA nucleotide. Levels of TTR mRNA were measured after incubation with 10 nM siRNA in primary mouse hepatocytes for 24 hours. TTR mRNA was assessed using RT-qPCR and normalized to PBS treated cells. All data points were the average of four measurements.

FIG. 27 is a graph showing the in vitro knockdown of TTR using siRNA modified with a single (S)-GNA nucleotide. Levels of TTR mRNA were measured after incubation with 10 nM siRNA in primary mouse hepatocytes for 24 hours. TTR mRNA was assessed using RT-qPCR and normalized to PBS treated cells. All data points were the average of four measurements. FIG. 27 shows the influence of single (S)-GNA nucleotide incorporation on the in vitro siRNA activity.

Figure 28:
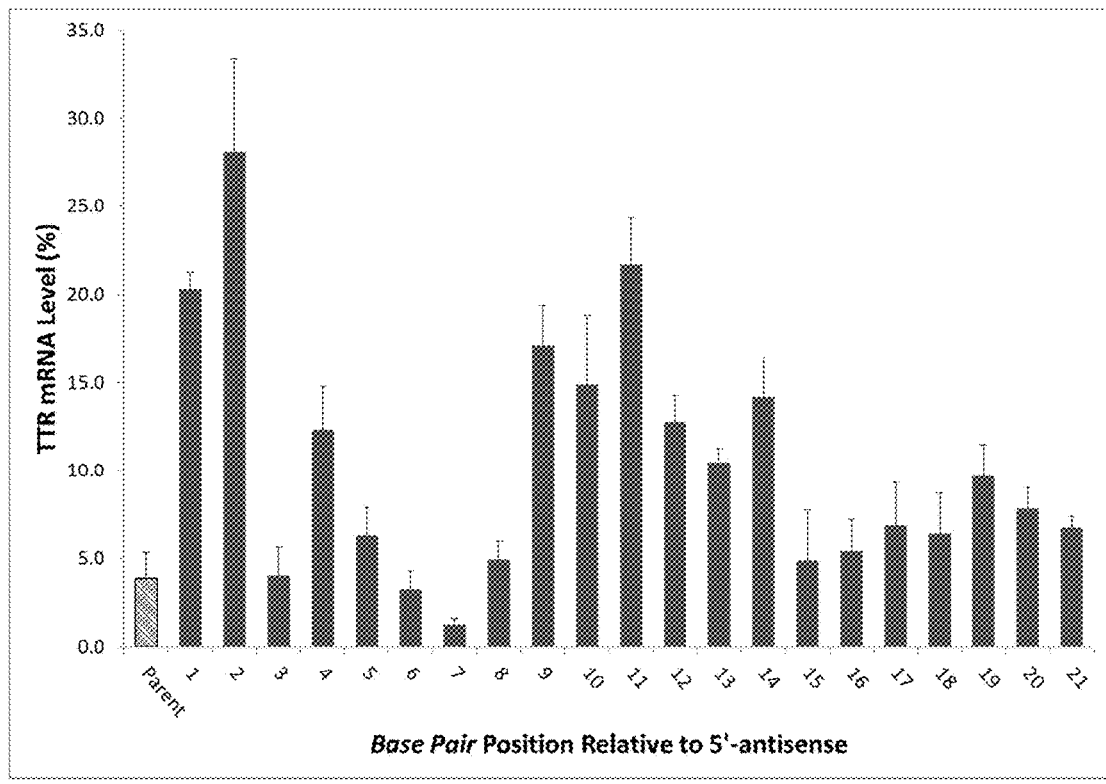
In FIG. 28, A) is a graph showing the in vitro knockdown of TTR using siRNA modified with a single (S)-GNA base pair. Levels of TTR mRNA were measured after incubation with 10 nM siRNA in primary mouse hepatocytes for 24 hours. TTR mRNA was assessed using RT-qPCR and normalized to PBS treated cells. All data points were the average of four measurements. B) shows mix and match duplexes where sense and antisense strands containing single (S)-GNA nucleotides were paired as GNA:RNA hetero-base pairs.
Figure 28:
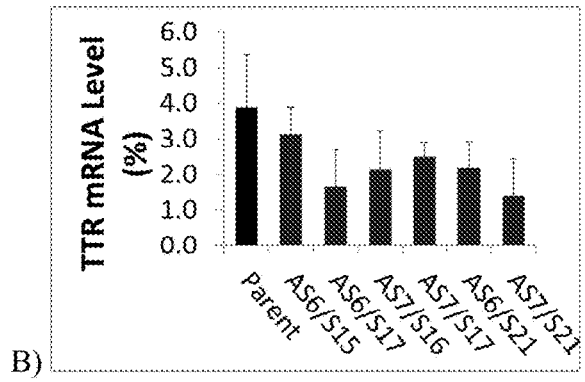
Figure 29:
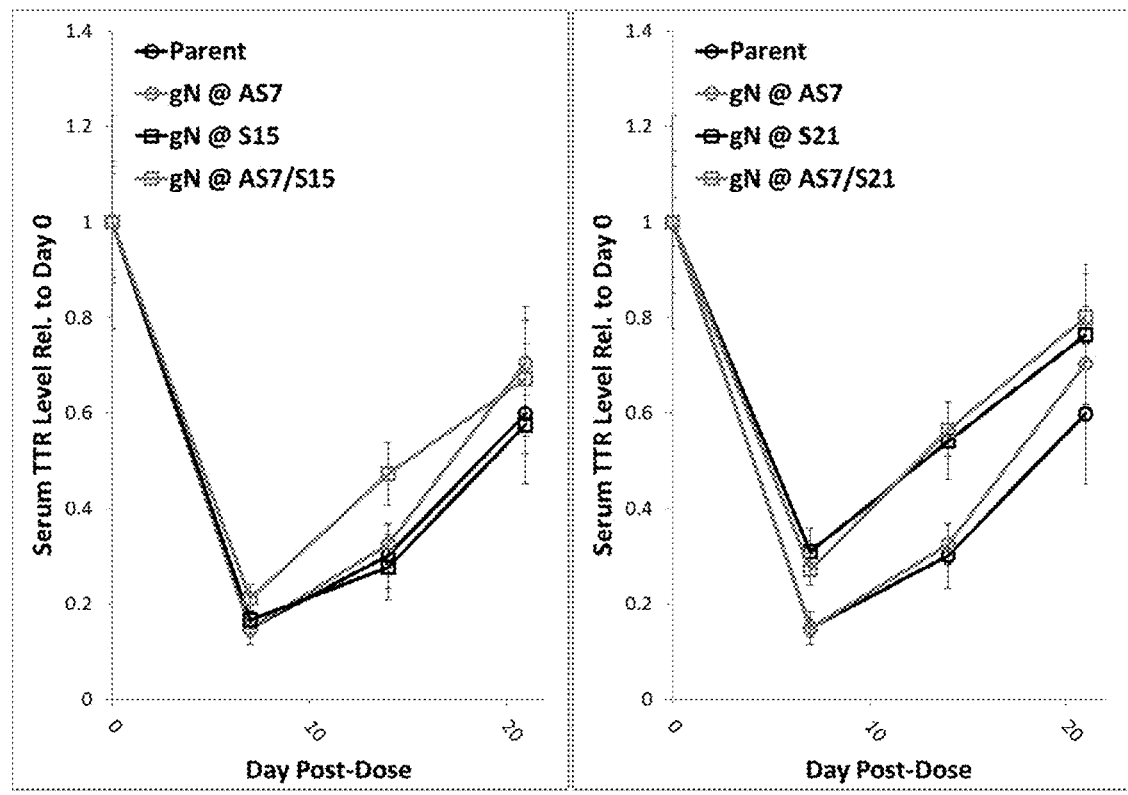
FIG. 29 is a graph showing the in vivo levels of TTR in mouse serum. Animals received a single dose of 2.5 mg/kg siRNA. At the indicated time pre- or post-dosing, animals were bled and serum samples were measured using a sandwich ELISA assay utilizing a HRP-conjugate antibody and 3,3',5,5'-tetramethylbenzidine for readout at 450 nm. All samples were measured in duplicate and each data point is the average of the mice in each cohort (n=3).

FIG. 28A is a graph showing the in vitro knockdown of TTR using siRNA modified with a single (S)-GNA base pair. Levels of TTR mRNA were measured after incubation with 10 nM siRNA in primary mouse hepatocytes for 24 hours. TTR mRNA was assessed using RT-qPCR and normalized to PBS treated cells. All data points were the average of four measurements. FIG. 28B shows mix and match duplexes where sense and antisense strands containing single (S)-GNA nucleotides were paired as GNA:RNA hetero-base pairs. FIG. 28 shows the influence of single (S)-GNA base pair incorporation on in vitro siRNA activity FIG. 29 is a graph showing the in vivo levels of TTR in mouse serum. Animals received a single dose of 2.5 mg/kg siRNA. At the indicated time pre- or post-dosing, animals were bled and serum samples were measured using a sandwich ELISA assay utilizing a HRP-conjugate antibody and 3,3',5,5'-tetramethylbenzidine for readout at 450 nm. All samples were measured in duplicate and each data point is the average of the mice in each cohort (n=3). FIG. 29 illustrates the effect of in vivo gene silencing in mice using GNA-modified siRNA duplexes on serum TTR levels.

Figure 30:
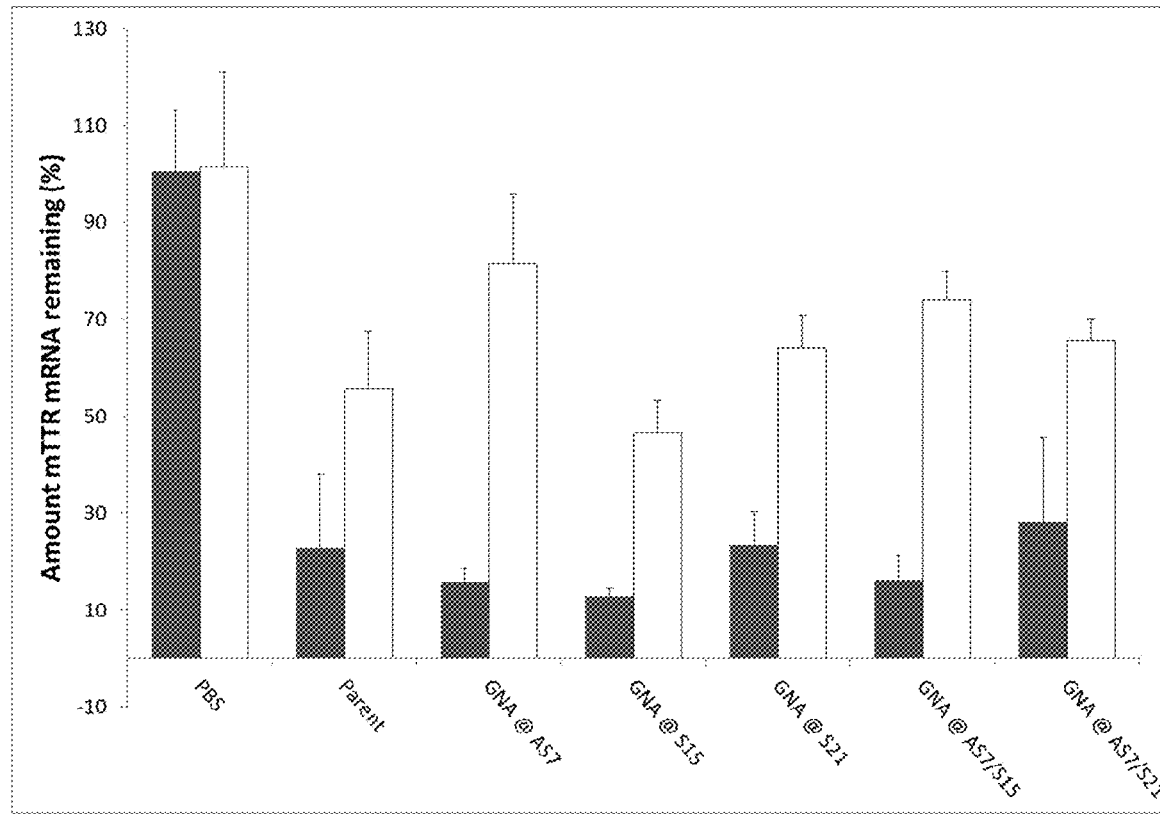
FIG. 30 is a graph showing the in vivo quantification of TTR mRNA levels. Animals received a single dose of 2.5 mg/kg siRNA. At the indicated time post-dosing, RNA extraction was performed on whole-liver homogenate. TTR mRNA was assessed as above by RT-qPCR, using the ΔΔCt method with GAPDH as the control transcript, and normalized to PBS-treated animals. Dark bars indicate the results for Day 21; and blank bars indicate the results for Day 7.

FIG. 30 is a graph showing the in vivo quantification of TTR mRNA levels. Animals received a single dose of 2.5 mg/kg siRNA. At the indicated time post-dosing, RNA extraction was performed on whole-liver homogenate. TTR mRNA was assessed as above by RT-qPCR, using the ΔΔCt method with GAPDH as the control transcript, and normalized to PBS-treated animals. FIG. 30 illustrates the effect of in vivo gene silencing in mice using GNA-modified siRNA duplexes on liver mRNA levels.

The results shown in the above figures demonstrate that GNA incorporation resulted in a position-dependent thermal destabilization of the resulting duplex. The extent of destabilization was nucleotide dependent; whereas substitution for an A or U nucleotide resulted in a much smaller $AT_M$ compared to GNA substitution for G or C nucleotides. The incorporation of single GNA nucleotides into the seed region of siRNA duplexes resulted in similar levels of knockdown of TTR mRNA in vitro. In addition, siRNA containing GNA base-pairs within the seed region, as well as mix and match duplexes, demonstrated higher levels of knockdown in vitro than the corresponding parent siRNA.

In vivo gene silencing correlated well with in vitro results for duplexes containing a single GNA substitution. Dual substitution of GNA resulted in a loss of in vivo silencing activity when compared to the single-substituted siRNAs.

All of the U.S. patents, U.S. patent application publications, foreign patents, foreign patent applications and non-patent publications referred to in this specification are incorporated herein by reference, in their entirety. Aspects of the embodiments can be modified, if necessary to employ concepts of the various patents, applications and publications to provide yet further embodiments.

These and other changes can be made to the embodiments in light of the above-detailed description. In general, in the following claims, the terms used should not be construed to limit the claims to the specific embodiments disclosed in the specification and the claims, but should be construed to include all possible embodiments along with the full scope of equivalents to which such claims are entitled. Accordingly, the claims are not limited by the disclosure.

SEQUENCE LISTING (456 sequences)

SEQ ID NO: 1 - protein, 16 aa, unidentified
AAVALLPAVLLALLAP

SEQ ID NO: 2 - protein, 11 aa, unidentified
AALLPVLLAAP

SEQ ID NO: 3 - protein, 13 aa, Human immunodeficiency virus 1
GRKKRRQRRRPPQ

SEQ ID NO: 4 - protein, 16 aa, Drosophila sp.
RQIKIWFQNRRMKWKK

SEQ ID NO: 5 - DNA, 21 bp, synthetic construct
  source 1..21: mol_type = other DNA
  modified_base 1: mod_base = OTHER; note = 2'-O-methylcytidine-3'-phosphate
  modified_base 2: mod_base = OTHER; note = 2'-O-methyluridine-3'-phosphate
  modified_base 3: mod_base = OTHER; note = 2'-O-methyluridine-3'-phosphate
  modified_base 4: mod_base = OTHER; note = adenosine-3'-phosphate
  modified_base 5: mod_base = OTHER; note = 2'-O-methylcytidine-3'-phosphate
  modified_base 6: mod_base = OTHER; note = guanosine-3'-phosphate
  modified_base 7: mod_base = OTHER; note = 2'-O-methylcytidine-3'-phosphate
  modified_base 8: mod_base = OTHER; note = 2'-O-methyluridine-3'-phosphate
  modified_base 9: mod_base = OTHER; note = guanosine-3'-phosphate
  modified_base 10: mod_base = OTHER; note = adenosine-3'-phosphate
  modified_base 11: mod_base = OTHER; note = guanosine-3'-phosphate
  modified_base 12: mod_base = OTHER; note = 2'-O-methyluridine-3'-phosphate
  modified_base 13: mod_base = OTHER; note = adenosine-3'-phosphate
  modified_base 14: mod_base = OTHER; note = 2'-O-methylcytidine-3'-phosphate
  modified_base 15: mod_base = OTHER; note = 2'-O-methyluridine-3'-phosphate
  modified_base 16: mod_base = OTHER; note = 2'-O-methyluridine-3'-phosphate
  modified_base 17: mod_base = OTHER; note = 2'-O-methylcytidine-3'-phosphate
  modified_base 18: mod_base = OTHER; note = guanosine-3'-phosphate
  modified_base 19: mod_base = OTHER; note = adenosine-3'-phosphate
  modified_base 20: mod_base = OTHER; note = 2'-deoxythymidine-3'-phosphorothioate
  modified_base 21: mod_base = OTHER; note = 2'-deoxythymidine-3'-phosphate
  misc_feature 1..19: note = RNA
  misc_feature 20..21: note = DNA
cttacgctgagtacttcgatt

SEQ ID NO: 6 - DNA, 21 bp, synthetic construct
  source 1..21: mol_type = other DNA
  modified_base 1: mod_base = OTHER; note = uridine-3'-phosphate
  modified_base 2: mod_base = OTHER; note = cytidine-3'-phosphate
  modified_base 3: mod_base = OTHER; note = guanosine-3'-phosphate
  modified_base 4: mod_base = OTHER; note = adenosine-3'-phosphate
  modified_base 5: mod_base = OTHER; note = adenosine-3'-phosphate
  modified_base 6: mod_base = OTHER; note = guanosine-3'-phosphate
  modified_base 7: mod_base = OTHER; note = 2'-O-methyluridine-3'-phosphate
  modified_base 8: mod_base = OTHER; note = adenosine-3'-phosphate
  modified_base 9: mod_base = OTHER; note = cytidine-3'-phosphate
  modified_base 10: mod_base = OTHER; note = uridine-3'-phosphate
  modified_base 11: mod_base = OTHER; note = 2'-O-methylcytidine-3'-phosphate
  modified_base 12: mod_base = OTHER; note = adenosine-3'-phosphate
  modified_base 13: mod_base = OTHER; note = guanosine-3'-phosphate
  modified_base 14: mod_base = OTHER; note = cytidine-3'-phosphate
  modified_base 15: mod_base = OTHER; note = guanosine-3'-phosphate
  modified_base 16: mod_base = OTHER; note = 2'-O-methyluridine-3'-phosphate
  modified_base 17: mod_base = OTHER; note = adenosine-3'-phosphate
  modified_base 18: mod_base = OTHER; note = adenosine-3'-phosphate
  modified_base 19: mod_base = OTHER; note = guanosine-3'-phosphate
  modified_base 20: mod_base = OTHER; note = 2'-deoxythymidine-3'-phosphorothioate
  modified_base 21: mod_base = OTHER; note = 2'-deoxythymidine-3'-phosphate
  misc_feature 1..19: note = RNA
  misc_feature 20..21: note = DNA
tcgaagtactcagcgtaagtt

SEQ ID NO: 7 - RNA, 21 nt, synthetic construct
  source 1..21: mol_type = other RNA
  modified_base 1: mod_base = OTHER; note = 2'-deoxy-2'-fluoroadenosine-3'-phosphorothioate
  modified_base 2: mod_base = OTHER; note = 2'-O-methyladenosine-3'-phosphorothioate
  modified_base 3: mod_base = OTHER; note = 2'-deoxy-2'-fluorocytidine-3'-phosphate
  modified_base 4: mod_base = OTHER; note = 2'-O-methyladenosine-3'-phosphate
  modified_base 5: mod_base = OTHER; note = 2'-deoxy-2'-fluoroguanosine-3'-phosphate
  modified_base 6: mod_base = OTHER; note = 2'-O-methyluridine-3'-phosphate
  modified_base 7: mod_base = OTHER; note = 2'-deoxy-2'-fluoroguanosine-3'-phosphate
  modified_base 8: mod_base = OTHER; note = 2'-O-methyluridine-3'-phosphate
  modified_base 9: mod_base = OTHER; note = 2'-deoxy-2'-fluorouridine-3'-phosphate
  modified_base 10: mod_base = OTHER; note = 2'-deoxy-2'-fluorocytidine-3'-phosphate
  modified_base 11: mod_base = OTHER; note = 2'-deoxy-2'-fluorouridine-3'-phosphate
  modified_base 12: mod_base = OTHER; note = 2'-O-methyluridine-3'-phosphate
  modified_base 13: mod_base = OTHER; note = 2'-deoxy-2'-fluoroguanosine-3'-phosphate
  modified_base 14: mod_base = OTHER; note = 2'-O-methylcytidine-3'-phosphate
  modified_base 15: mod_base = OTHER; note = 2'-deoxy-2'-fluorouridine-3'-phosphate
  modified_base 16: mod_base = OTHER; note = 2'-O-methylcytidine-3'-phosphate
  modified_base 17: mod_base = OTHER; note = 2'-deoxy-2'-fluorouridine-3'-phosphate
  modified_base 18: mod_base = OTHER; note = 2'-O-methyladenosine-3'-phosphate
  modified_base 19: mod_base = OTHER; note = 2'-deoxy-2'-fluorouridine-3'-phosphate
  modified_base 20: mod_base = OTHER; note = 2'-O-methyladenosine-3'-phosphate
  modified_base 21: mod_base = OTHER; note = 2'-deoxy-2'-fluoroadenosine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
aacagtgttcttgctctataa

SEQ ID NO: 8 - DNA, 21 bp, synthetic construct
  source 1..21: mol_type = other DNA
  modified_base 1: mod_base = OTHER; note = 2'-O-methyladenosine-3'-phosphorothioate
  modified_base 2: mod_base = OTHER; note = 2'-O-methyladenosine-3'-phosphorothioate
  modified_base 3: mod_base = OTHER; note = 2'-O-methylcytidine-3'-phosphate
  modified_base 4: mod_base = OTHER; note = 2'-O-methyladenosine-3'-phosphate
  modified_base 5: mod_base = OTHER; note = 2'-O-methylguanosine-3'-phosphate
  modified_base 6: mod_base = OTHER; note = 2'-O-methyluridine-3'-phosphate
  modified_base 7: mod_base = OTHER; note = 2'-O-methylguanosine-3'-phosphate
  modified_base 8: mod_base = OTHER; note = 2'-O-methyluridine-3'-phosphate
  modified_base 9: mod_base = OTHER; note = 2'-O-methyluridine-3'-phosphate
  modified_base 10: mod_base = OTHER; note = 2'-O-methylcytidine-3'-phosphate
  modified_base 12: mod_base = OTHER; note = 2'-O-methyluridine-3'-phosphate
  modified_base 13: mod_base = OTHER; note = 2'-O-methylguanosine-3'-phosphate
  modified_base 14: mod_base = OTHER; note = 2'-O-methylcytidine-3'-phosphate
  modified_base 15: mod_base = OTHER; note = 2'-O-methyluridine-3'-phosphate
  modified_base 16: mod_base = OTHER; note = 2'-O-methylcytidine-3'-phosphate
  modified_base 17: mod_base = OTHER; note = 2'-O-methyluridine-3'-phosphate
  modified_base 18: mod_base = OTHER; note = 2'-O-methyladenosine-3'-phosphate
  modified_base 19: mod_base = OTHER; note = 2'-O-methyluridine-3'-phosphate
  modified_base 20: mod_base = OTHER; note = 2'-O-methyladenosine-3'-phosphate
  modified_base 21: mod_base = OTHER; note = 2'-O-methyladenosine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
  misc_feature 1..10: note = RNA
  misc_feature 12..21: note = RNA
  misc_feature 11: note = DNA
aacagtgttcttgctctataa

SEQ ID NO: 9 - DNA, 21 bp, synthetic construct
  source 1..21: mol_type = other DNA
  modified_base 1: mod_base = OTHER; note = 2'-O-methyladenosine-3'-phosphorothioate
  modified_base 2: mod_base = OTHER; note = 2'-O-methyladenosine-3'-phosphorothioate
  modified_base 3: mod_base = OTHER; note = 2'-O-methylcytidine-3'-phosphate
  modified_base 4: mod_base = OTHER; note = 2'-O-methyladenosine-3'-phosphate
  modified_base 5: mod_base = OTHER; note = 2'-O-methylguanosine-3'-phosphate
  modified_base 6: mod_base = OTHER; note = 2'-O-methyluridine-3'-phosphate
  modified_base 7: mod_base = OTHER; note = 2'-O-methylguanosine-3'-phosphate
  modified_base 8: mod_base = OTHER; note = 2'-O-methyluridine-3'-phosphate
  modified_base 9: mod_base = OTHER; note = 2'-O-methyluridine-3'-phosphate
  modified_base 10: mod_base = OTHER; note = 2'-O-methylcytidine-3'-phosphate
  modified_base 12: mod_base = OTHER; note = 2'-O-methyluridine-3'-phosphate
  modified_base 13: mod_base = OTHER; note = 2'-O-methylguanosine-3'-phosphate
  modified_base 14: mod_base = OTHER; note = 2'-O-methylcytidine-3'-phosphate
  modified_base 15: mod_base = OTHER; note = 2'-O-methyluridine-3'-phosphate
  modified_base 16: mod_base = OTHER; note = 2'-O-methylcytidine-3'-phosphate
  modified_base 18: mod_base = OTHER; note = 2'-O-methyladenosine-3'-phosphate
  modified_base 19: mod_base = OTHER; note = 2'-O-methyluridine-3'-phosphate
  modified_base 20: mod_base = OTHER; note = 2'-O-methyladenosine-3'-phosphate
  modified_base 21: mod_base = OTHER; note = 2'-O-methyladenosine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
  misc_feature 1..10: note = RNA
  misc_feature 12..16: note = RNA
  misc_feature 18..21: note = RNA
  misc_feature 11: note = DNA
  misc_feature 17: note = DNA
aacagtgttcttgctctataa

SEQ ID NO: 10 - DNA, 21 bp, synthetic construct
  source 1..21: mol_type = other DNA
  modified_base 1: mod_base = OTHER; note = 2'-O-methyladenosine-3'-phosphorothioate
  modified_base 2: mod_base = OTHER; note = 2'-O-methyladenosine-3'-phosphorothioate
  modified_base 3: mod_base = OTHER; note = 2'-O-methylcytidine-3'-phosphate
  modified_base 4: mod_base = OTHER; note = 2'-O-methyladenosine-3'-phosphate
  modified_base 5: mod_base = OTHER; note = 2'-O-methylguanosine-3'-phosphate
  modified_base 6: mod_base = OTHER; note = 2'-O-methyluridine-3'-phosphate
  modified_base 7: mod_base = OTHER; note = 2'-O-methylguanosine-3'-phosphate
  modified_base 8: mod_base = OTHER; note = 2'-O-methyluridine-3'-phosphate
  modified_base 9: mod_base = OTHER; note = 2'-O-methyluridine-3'-phosphate
  modified_base 10: mod_base = OTHER; note = 2'-O-methylcytidine-3'-phosphate
  modified_base 12: mod_base = OTHER; note = 2'-O-methyluridine-3'-phosphate
  modified_base 13: mod_base = OTHER; note = 2'-O-methylguanosine-3'-phosphate
  modified_base 14: mod_base = OTHER; note = 2'-O-methylcytidine-3'-phosphate
  modified_base 15: mod_base = OTHER; note = 2'-O-methyluridine-3'-phosphate
  modified_base 16: mod_base = OTHER; note = 2'-O-methylcytidine-3'-phosphate
  modified_base 17: mod_base = OTHER; note = Thymidine-glycol nucleic acid (GNA), S-Isomer
  modified_base 18: mod_base = OTHER; note = 2'-O-methyladenosine-3'-phosphate
  modified_base 19: mod_base = OTHER; note = 2'-O-methyluridine-3'-phosphate
  modified_base 20: mod_base = OTHER; note = 2'-O-methyladenosine-3'-phosphate
  modified_base 21: mod_base = OTHER; note = 2'-O-methyladenosine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
  misc_feature 1..10: note = RNA
  misc_feature 12..21: note = RNA
  misc_feature 11: note = DNA
aacagtgttcttgctctataa

SEQ ID NO: 11 - DNA, 21 bp, synthetic construct
  source 1..21: mol_type = other DNA
  modified_base 1: mod_base = OTHER; note = 2'-O-methyladenosine-3'-phosphorothioate
  modified_base 2: mod_base = OTHER; note = 2'-O-methyladenosine-3'-phosphorothioate
  modified_base 3: mod_base = OTHER; note = 2'-O-methylcytidine-3'-phosphate
  modified_base 4: mod_base = OTHER; note = 2'-O-methyladenosine-3'-phosphate
  modified_base 5: mod_base = OTHER; note = 2'-O-methylguanosine-3'-phosphate
  modified_base 6: mod_base = OTHER; note = 2'-O-methyluridine-3'-phosphate
  modified_base 7: mod_base = OTHER; note = 2'-O-methylguanosine-3'-phosphate
  modified_base 8: mod_base = OTHER; note = 2'-O-methyluridine-3'-phosphate
  modified_base 9: mod_base = OTHER; note = 2'-O-methyluridine-3'-phosphate
  modified_base 10: mod_base = OTHER; note = 2'-O-methylcytidine-3'-phosphate
  modified_base 12: mod_base = OTHER; note = 2'-O-methyluridine-3'-phosphate
  modified_base 13: mod_base = OTHER; note = 2'-O-methylguanosine-3'-phosphate
  modified_base 14: mod_base = OTHER; note = 2'-O-methylcytidine-3'-phosphate
  modified_base 15: mod_base = OTHER; note = 2'-O-methyluridine-3'-phosphate
  modified_base 16: mod_base = OTHER; note = 2'-O-methylcytidine-3'-phosphate
  modified_base 18: mod_base = OTHER; note = 2'-O-methyladenosine-3'-phosphate
  modified_base 19: mod_base = OTHER; note = 2'-O-methyluridine-3'-phosphate
  modified_base 20: mod_base = OTHER; note = 2'-O-methyladenosine-3'-phosphate
  modified_base 21: mod_base = OTHER; note = 2'-O-methyladenosine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
  misc_feature 1..10: note = RNA
  misc_feature 12..16: note = RNA
  misc_feature 18..21: note = RNA
  misc_feature 11: note = DNA
  misc_feature 17: note = DNA
aacagtgttcttgctctataa

SEQ ID NO: 12 - DNA, 21 bp, synthetic construct
  source 1..21: mol_type = other DNA
  modified_base 1: mod_base = OTHER; note = 2'-O-methyladenosine-3'-phosphorothioate
  modified_base 2: mod_base = OTHER; note = 2'-O-methyladenosine-3'-phosphorothioate
  modified_base 3: mod_base = OTHER; note = 2'-O-methylcytidine-3'-phosphate
  modified_base 4: mod_base = OTHER; note = 2'-O-methyladenosine-3'-phosphate
  modified_base 5: mod_base = OTHER; note = 2'-O-methylguanosine-3'-phosphate
  modified_base 6: mod_base = OTHER; note = 2'-O-methyluridine-3'-phosphate
  modified_base 7: mod_base = OTHER; note = 2'-O-methylguanosine-3'-phosphate
  modified_base 8: mod_base = OTHER; note = 2'-O-methyluridine-3'-phosphate
  modified_base 9: mod_base = OTHER; note = 2'-O-methyluridine-3'-phosphate
  modified_base 10: mod_base = OTHER; note = 2'-O-methylcytidine-3'-phosphate
  modified_base 12: mod_base = OTHER; note = 2'-O-methyluridine-3'-phosphate
  modified_base 13: mod_base = OTHER; note = 2'-O-methylguanosine-3'-phosphate
  modified_base 14: mod_base = OTHER; note = 2'-O-methylcytidine-3'-phosphate
  modified_base 15: mod_base = OTHER; note = 2'-O-methyluridine-3'-phosphate
  modified_base 16: mod_base = OTHER; note = 2'-O-methylcytidine-3'-phosphate
  modified_base 17: mod_base = OTHER; note = Thymidine-glycol nucleic acid (GNA), S-Isomer
  modified_base 18: mod_base = OTHER; note = 2'-O-methyladenosine-3'-phosphate
  modified_base 19: mod_base = OTHER; note = 2'-O-methyluridine-3'-phosphate
  modified_base 20: mod_base = OTHER; note = 2'-O-methyladenosine-3'-phosphate
  modified_base 21: mod_base = OTHER; note = 2'-O-methyladenosine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
  misc_feature 1..10: note = RNA
  misc_feature 12..21: note = RNA
  misc_feature 11: note = DNA
aacagtgttcttgctctataa

SEQ ID NO: 13 - RNA, 21 nt, synthetic construct
  source 1..21: mol_type = other RNA
  modified_base 1: mod_base = OTHER; note = 2'-deoxy-2'-fluoroadenosine-3'-phosphorothioate
  modified_base 2: mod_base = OTHER; note = 2'-O-methyladenosine-3'-phosphorothioate
  modified_base 3: mod_base = OTHER; note = 2'-deoxy-2'-fluorocytidine-3'-phosphate
  modified_base 4: mod_base = OTHER; note = 2'-O-methyladenosine-3'-phosphate
  modified_base 5: mod_base = OTHER; note = 2'-deoxy-2'-fluoroguanosine-3'-phosphate
  modified_base 6: mod_base = OTHER; note = 2'-O-methyluridine-3'-phosphate
  modified_base 7: mod_base = OTHER; note = 2'-deoxy-2'-fluoroguanosine-3'-phosphate
  modified_base 8: mod_base = OTHER; note = 2'-O-methyluridine-3'-phosphate
  modified_base 9: mod_base = OTHER; note = 2'-deoxy-2'-fluorouridine-3'-phosphate
  modified_base 10: mod_base = OTHER; note = 2'-deoxy-2'-fluorocytidine-3'-phosphate
  modified_base 11: mod_base = OTHER; note = 2'-deoxy-2'-fluorouridine-3'-phosphate
  modified_base 12: mod_base = OTHER; note = 2'-O-methyluridine-3'-phosphate
  modified_base 13: mod_base = OTHER; note = 2'-deoxy-2'-fluoroguanosine-3'-phosphate
  modified_base 14: mod_base = OTHER; note = 2'-O-methylcytidine-3'-phosphate
  modified_base 15: mod_base = OTHER; note = 2'-deoxy-2'-fluorouridine-3'-phosphate
  modified_base 16: mod_base = OTHER; note = 2'-O-methylcytidine-3'-phosphate
  modified_base 17: mod_base = OTHER; note = 2'-deoxy-2'-fluorouridine-3'-phosphate
  modified_base 18: mod_base = OTHER; note = 2'-O-methyladenosine-3'-phosphate
  modified_base 19: mod_base = OTHER; note = 2'-deoxy-2'-fluorouridine-3'-phosphate
  modified_base 20: mod_base = OTHER; note = 2'-O-methyladenosine-3'-phosphate
  modified_base 21: mod_base = OTHER; note = 2'-deoxy-2'-fluoroadenosine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
aacagtgttcttgctctataa

SEQ ID NO: 14 - DNA, 21 bp, synthetic construct
  source 1..21: mol_type = other DNA
  modified_base 1: mod_base = OTHER; note = 2'-O-methyladenosine-3'-phosphorothioate
  modified_base 2: mod_base = OTHER; note = 2'-O-methyladenosine-3'-phosphorothioate
  modified_base 3: mod_base = OTHER; note = 2'-O-methylcytidine-3'-phosphate
  modified_base 4: mod_base = OTHER; note = 2'-O-methyladenosine-3'-phosphate
  modified_base 5: mod_base = OTHER; note = 2'-O-methylguanosine-3'-phosphate
  modified_base 6: mod_base = OTHER; note = 2'-O-methyluridine-3'-phosphate
  modified_base 7: mod_base = OTHER; note = 2'-O-methylguanosine-3'-phosphate
  modified_base 8: mod_base = OTHER; note = 2'-O-methyluridine-3'-phosphate
  modified_base 9: mod_base = OTHER; note = 2'-O-methyluridine-3'-phosphate
  modified_base 10: mod_base = OTHER; note = 2'-O-methylcytidine-3'-phosphate
  modified_base 12: mod_base = OTHER; note = 2'-O-methyluridine-3'-phosphate
  modified_base 13: mod_base = OTHER; note = 2'-O-methylguanosine-3'-phosphate
  modified_base 14: mod_base = OTHER; note = 2'-O-methylcytidine-3'-phosphate
  modified_base 15: mod_base = OTHER; note = 2'-O-methyluridine-3'-phosphate
  modified_base 16: mod_base = OTHER; note = 2'-O-methylcytidine-3'-phosphate
  modified_base 17: mod_base = OTHER; note = 2-hydroxymethyl-4-methoxy-tetrahydrofuran-3-phosphate
  modified_base 18: mod_base = OTHER; note = 2'-O-methyladenosine-3'-phosphate
  modified_base 19: mod_base = OTHER; note = 2'-O-methyluridine-3'-phosphate
  modified_base 20: mod_base = OTHER; note = 2'-O-methyladenosine-3'-phosphate
  modified_base 21: mod_base = OTHER; note = 2'-O-methyladenosine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
  misc_feature 1..10: note = RNA
  misc_feature 12..21: note = RNA
  misc_feature 11: note = DNA
aacagtgttcttgctcnataa

SEQ ID NO: 15 - DNA, 21 bp, synthetic construct
  source 1..21: mol_type = other DNA
  modified_base 1: mod_base = OTHER; note = 2'-O-methyladenosine-3'-phosphorothioate
  modified_base 2: mod_base = OTHER; note = 2'-O-methyladenosine-3'-phosphorothioate
  modified_base 3: mod_base = OTHER; note = 2'-O-methylcytidine-3'-phosphate
  modified_base 4: mod_base = OTHER; note = 2'-O-methyladenosine-3'-phosphate
  modified_base 5: mod_base = OTHER; note = 2'-O-methylguanosine-3'-phosphate
  modified_base 6: mod_base = OTHER; note = 2'-O-methyluridine-3'-phosphate
  modified_base 7: mod_base = OTHER; note = 2'-O-methylguanosine-3'-phosphate
  modified_base 8: mod_base = OTHER; note = 2'-O-methyluridine-3'-phosphate
  modified_base 9: mod_base = OTHER; note = 2'-O-methyluridine-3'-phosphate
  modified_base 10: mod_base = OTHER; note = 2'-O-methylcytidine-3'-phosphate
  modified_base 12: mod_base = OTHER; note = 2'-O-methyluridine-3'-phosphate
  modified_base 13: mod_base = OTHER; note = 2'-O-methylguanosine-3'-phosphate
  modified_base 14: mod_base = OTHER; note = 2'-O-methylcytidine-3'-phosphate
  modified_base 15: mod_base = OTHER; note = 2'-O-methyluridine-3'-phosphate
  modified_base 16: mod_base = OTHER; note = 2'-O-methylcytidine-3'-phosphate
  modified_base 17: mod_base = OTHER; note = 2'-O-methyladenosine-3'-phosphate
  modified_base 18: mod_base = OTHER; note = 2'-O-methyladenosine-3'-phosphate
  modified_base 19: mod_base = OTHER; note = 2'-O-methyluridine-3'-phosphate
  modified_base 20: mod_base = OTHER; note = 2'-O-methyladenosine-3'-phosphate
  modified_base 21: mod_base = OTHER; note = 2'-O-methyladenosine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
  misc_feature 1..10: note = RNA
  misc_feature 12..21: note = RNA
  misc_feature 11: note = DNA
aacagtgttcttgctcaataa

SEQ ID NO: 16 - DNA, 21 bp, synthetic construct
  source 1..21: mol_type = other DNA
  modified_base 1: mod_base = OTHER; note = 2'-O-methyladenosine-3'-phosphorothioate
  modified_base 2: mod_base = OTHER; note = 2'-O-methyladenosine-3'-phosphorothioate
  modified_base 3: mod_base = OTHER; note = 2'-O-methylcytidine-3'-phosphate
  modified_base 4: mod_base = OTHER; note = 2'-O-methyladenosine-3'-phosphate
  modified_base 5: mod_base = OTHER; note = 2'-O-methylguanosine-3'-phosphate
  modified_base 6: mod_base = OTHER; note = 2'-O-methyluridine-3'-phosphate
  modified_base 7: mod_base = OTHER; note = 2'-O-methylguanosine-3'-phosphate
  modified_base 8: mod_base = OTHER; note = 2'-O-methyluridine-3'-phosphate
  modified_base 9: mod_base = OTHER; note = 2'-O-methyluridine-3'-phosphate
  modified_base 10: mod_base = OTHER; note = 2'-O-methylcytidine-3'-phosphate
  modified_base 12: mod_base = OTHER; note = 2'-O-methyluridine-3'-phosphate
  modified_base 13: mod_base = OTHER; note = 2'-O-methylguanosine-3'-phosphate
  modified_base 14: mod_base = OTHER; note = 2'-O-methylcytidine-3'-phosphate
  modified_base 15: mod_base = OTHER; note = 2'-O-methyluridine-3'-phosphate
  modified_base 16: mod_base = OTHER; note = 2'-O-methylcytidine-3'-phosphate
  modified_base 17: mod_base = OTHER; note = 2'-O-methylcytidine-3'-phosphate
  modified_base 18: mod_base = OTHER; note = 2'-O-methyladenosine-3'-phosphate
  modified_base 19: mod_base = OTHER; note = 2'-O-methyluridine-3'-phosphate
  modified_base 20: mod_base = OTHER; note = 2'-O-methyladenosine-3'-phosphate
  modified_base 21: mod_base = OTHER; note = 2'-O-methyladenosine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
  misc_feature 1..10: note = RNA
  misc_feature 12..21: note = RNA
  misc_feature 11: note = DNA
aacagtgttcttgctccataa

SEQ ID NO: 17 - DNA, 21 bp, synthetic construct
  source 1..21: mol_type = other DNA
  modified_base 1: mod_base = OTHER; note = 2'-O-methyladenosine-3'-phosphorothioate
  modified_base 2: mod_base = OTHER; note = 2'-O-methyladenosine-3'-phosphorothioate
  modified_base 3: mod_base = OTHER; note = 2'-O-methylcytidine-3'-phosphate
  modified_base 4: mod_base = OTHER; note = 2'-O-methyladenosine-3'-phosphate
  modified_base 5: mod_base = OTHER; note = 2'-O-methylguanosine-3'-phosphate
  modified_base 6: mod_base = OTHER; note = 2'-O-methyluridine-3'-phosphate
  modified_base 7: mod_base = OTHER; note = 2'-O-methylguanosine-3'-phosphate
  modified_base 8: mod_base = OTHER; note = 2'-O-methyluridine-3'-phosphate
  modified_base 9: mod_base = OTHER; note = 2'-O-methyluridine-3'-phosphate
  modified_base 10: mod_base = OTHER; note = 2'-O-methylcytidine-3'-phosphate
  modified_base 12: mod_base = OTHER; note = 2'-O-methyluridine-3'-phosphate
  modified_base 13: mod_base = OTHER; note = 2'-O-methylguanosine-3'-phosphate
  modified_base 14: mod_base = OTHER; note = 2'-O-methylcytidine-3'-phosphate
  modified_base 15: mod_base = OTHER; note = 2'-O-methyluridine-3'-phosphate
  modified_base 16: mod_base = OTHER; note = 2'-O-methylcytidine-3'-phosphate
  modified_base 17: mod_base = OTHER; note = 2'-O-methylguanosine-3'-phosphate
  modified_base 18: mod_base = OTHER; note = 2'-O-methyladenosine-3'-phosphate
  modified_base 19: mod_base = OTHER; note = 2'-O-methyluridine-3'-phosphate
  modified_base 20: mod_base = OTHER; note = 2'-O-methyladenosine-3'-phosphate
  modified_base 21: mod_base = OTHER; note = 2'-O-methyladenosine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
  misc_feature 1..10: note = RNA
  misc_feature 12..21: note = RNA
  misc_feature 11: note = DNA
aacagtgttcttgctcgataa

SEQ ID NO: 18 - DNA, 21 bp, synthetic construct
  source 1..21: mol_type = other DNA
  modified_base 1: mod_base = OTHER; note = 2'-O-methyladenosine-3'-phosphorothioate
  modified_base 2: mod_base = OTHER; note = 2'-O-methyladenosine-3'-phosphorothioate
  modified_base 3: mod_base = OTHER; note = 2'-O-methylcytidine-3'-phosphate
  modified_base 4: mod_base = OTHER; note = 2'-O-methyladenosine-3'-phosphate
  modified_base 5: mod_base = OTHER; note = 2'-O-methylguanosine-3'-phosphate
  modified_base 6: mod_base = OTHER; note = 2'-O-methyluridine-3'-phosphate
  modified_base 7: mod_base = OTHER; note = 2'-O-methylguanosine-3'-phosphate
  modified_base 8: mod_base = OTHER; note = 2'-O-methyluridine-3'-phosphate
  modified_base 9: mod_base = OTHER; note = 2'-O-methyluridine-3'-phosphate
  modified_base 10: mod_base = OTHER; note = 2'-O-methylcytidine-3'-phosphate
  modified_base 12: mod_base = OTHER; note = 2'-O-methyluridine-3'-phosphate
  modified_base 13: mod_base = OTHER; note = 2'-O-methylguanosine-3'-phosphate
  modified_base 14: mod_base = OTHER; note = 2'-O-methylcytidine-3'-phosphate
  modified_base 15: mod_base = OTHER; note = 2'-O-methyluridine-3'-phosphate
  modified_base 16: mod_base = OTHER; note = 2'-O-methylcytidine-3'-phosphate
  modified_base 17: mod_base = OTHER; note = uridine-3'-phosphate
  modified_base 18: mod_base = OTHER; note = 2'-O-methyladenosine-3'-phosphate
  modified_base 19: mod_base = OTHER; note = 2'-O-methyluridine-3'-phosphate
  modified_base 20: mod_base = OTHER; note = 2'-O-methyladenosine-3'-phosphate
  modified_base 21: mod_base = OTHER; note = 2'-O-methyladenosine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
  misc_feature 1..10: note = RNA
  misc_feature 12..21: note = RNA
  misc_feature 11: note = DNA
aacagtgttcttgctctataa

SEQ ID NO: 19 - DNA, 21 bp, synthetic construct
  source 1..21: mol_type = other DNA
  modified_base 1: mod_base = OTHER; note = 2'-O-methyladenosine-3'-phosphorothioate
  modified_base 2: mod_base = OTHER; note = 2'-O-methyladenosine-3'-phosphorothioate
  modified_base 3: mod_base = OTHER; note = 2'-O-methylcytidine-3'-phosphate
  modified_base 4: mod_base = OTHER; note = 2'-O-methyladenosine-3'-phosphate
  modified_base 5: mod_base = OTHER; note = 2'-O-methylguanosine-3'-phosphate
  modified_base 6: mod_base = OTHER; note = 2'-O-methyluridine-3'-phosphate
  modified_base 7: mod_base = OTHER; note = 2'-O-methylguanosine-3'-phosphate
  modified_base 8: mod_base = OTHER; note = 2'-O-methyluridine-3'-phosphate
  modified_base 9: mod_base = OTHER; note = 2'-O-methyluridine-3'-phosphate
  modified_base 10: mod_base = OTHER; note = 2'-O-methylcytidine-3'-phosphate
  modified_base 12: mod_base = OTHER; note = 2'-O-methyluridine-3'-phosphate
  modified_base 13: mod_base = OTHER; note = 2'-O-methylguanosine-3'-phosphate
  modified_base 14: mod_base = OTHER; note = 2'-O-methylcytidine-3'-phosphate
  modified_base 15: mod_base = OTHER; note = 2'-O-methyluridine-3'-phosphate
  modified_base 16: mod_base = OTHER; note = 2'-O-methylcytidine-3'-phosphate
  modified_base 17: mod_base = OTHER; note = 2'-O-methylguanosine-3'-phosphate
  modified_base 18: mod_base = OTHER; note = 2'-O-methyladenosine-3'-phosphate
  modified_base 19: mod_base = OTHER; note = 2'-O-methyluridine-3'-phosphate
  modified_base 20: mod_base = OTHER; note = 2'-O-methyladenosine-3'-phosphate
  modified_base 21: mod_base = OTHER; note = 2'-O-methyladenosine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
  misc_feature 1..10: note = RNA
  misc_feature 12..21: note = RNA
  misc_feature 11: note = DNA
aacagtgttcttgctcgataa

SEQ ID NO: 20 - RNA, 21 nt, synthetic construct
  source 1..21: mol_type = other RNA
  modified_base 1: mod_base = OTHER; note = 2'-deoxy-2'-fluoroadenosine-3'-phosphorothioate
  modified_base 2: mod_base = OTHER; note = 2'-O-methylcytidine-3'-phosphorothioate
  modified_base 3: mod_base = OTHER; note = 2'-deoxy-2'-fluoroadenosine-3'-phosphate
  modified_base 4: mod_base = OTHER; note = 2'-O-methyluridine-3'-phosphate
  modified_base 5: mod_base = OTHER; note = 2'-deoxy-2'-fluoroadenosine-3'-phosphate
  modified_base 6: mod_base = OTHER; note = 2'-O-methyluridine-3'-phosphate
  modified_base 7: mod_base = OTHER; note = 2'-deoxy-2'-fluorouridine-3'-phosphate
  modified_base 8: mod_base = OTHER; note = 2'-O-methyluridine-3'-phosphate
  modified_base 9: mod_base = OTHER; note = 2'-deoxy-2'-fluoroguanosine-3'-phosphate
  modified_base 10: mod_base = OTHER; note = 2'-deoxy-2'-fluoroadenosine-3'-phosphate
  modified_base 11: mod_base = OTHER; note = 2'-deoxy-2'-fluorouridine-3'-phosphate
  modified_base 12: mod_base = OTHER; note = 2'-O-methylcytidine-3'-phosphate
  modified_base 13: mod_base = OTHER; note = 2'-deoxy-2'-fluoroadenosine-3'-phosphate
  modified_base 14: mod_base = OTHER; note = 2'-O-methylguanosine-3'-phosphate
  modified_base 15: mod_base = OTHER; note = 2'-deoxy-2'-fluorouridine-3'-phosphate
  modified_base 16: mod_base = OTHER; note = 2'-O-methylcytidine-3'-phosphate
  modified_base 17: mod_base = OTHER; note = 2'-deoxy-2'-fluorouridine-3'-phosphate
  modified_base 18: mod_base = OTHER; note = 2'-O-methyluridine-3'-phosphate
  modified_base 19: mod_base = OTHER; note = 2'-deoxy-2'-fluorouridine-3'-phosphate
  modified_base 20: mod_base = OTHER; note = 2'-O-methyluridine-3'-phosphate
  modified_base 21: mod_base = OTHER; note = 2'-deoxy-2'-fluorouridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
acatatttgatcagtcttttt

SEQ ID NO: 21 - DNA, 21 bp, synthetic construct
  source 1..21: mol_type = other DNA
  modified_base 1: mod_base = OTHER; note = 2'-O-methyladenosine-3'-phosphorothioate
  modified_base 2: mod_base = OTHER; note = 2'-O-methylcytidine-3'-phosphorothioate
  modified_base 3: mod_base = OTHER; note = 2'-O-methyladenosine-3'-phosphate
  modified_base 4: mod_base = OTHER; note = 2'-O-methyluridine-3'-phosphate
  modified_base 5: mod_base = OTHER; note = 2'-O-methyladenosine-3'-phosphate
  modified_base 6: mod_base = OTHER; note = 2'-O-methyluridine-3'-phosphate
  modified_base 7: mod_base = OTHER; note = 2'-O-methyluridine-3'-phosphate
  modified_base 8: mod_base = OTHER; note = 2'-O-methyluridine-3'-phosphate
  modified_base 9: mod_base = OTHER; note = 2'-O-methylguanosine-3'-phosphate
  modified_base 10: mod_base = OTHER; note = 2'-O-methyladenosine-3'-phosphate
  modified_base 12: mod_base = OTHER; note = 2'-O-methylcytidine-3'-phosphate
  modified_base 13: mod_base = OTHER; note = 2'-O-methyladenosine-3'-phosphate
  modified_base 14: mod_base = OTHER; note = 2'-O-methylguanosine-3'-phosphate
  modified_base 15: mod_base = OTHER; note = 2'-O-methyluridine-3'-phosphate
  modified_base 16: mod_base = OTHER; note = 2'-O-methylcytidine-3'-phosphate
  modified_base 17: mod_base = OTHER; note = Thymidine-glycol nucleic acid (GNA), S-Isomer
  modified_base 18: mod_base = OTHER; note = 2'-O-methyluridine-3'-phosphate
  modified_base 19: mod_base = OTHER; note = 2'-O-methyluridine-3'-phosphate
  modified_base 20: mod_base = OTHER; note = 2'-O-methyluridine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
  misc_feature 1..10: note = RNA
  misc_feature 12..21: note = RNA
  misc_feature 11: note = DNA
acatatttgatcagtcttttt

SEQ ID NO: 22 - DNA, 21 bp, synthetic construct
  source 1..21: mol_type = other DNA
  modified_base 1: mod_base = OTHER; note = 2'-O-methyladenosine-3'-phosphorothioate
  modified_base 2: mod_base = OTHER; note = 2'-O-methylcytidine-3'-phosphorothioate
  modified_base 3: mod_base = OTHER; note = 2'-O-methyladenosine-3'-phosphate
  modified_base 4: mod_base = OTHER; note = 2'-O-methyluridine-3'-phosphate
  modified_base 5: mod_base = OTHER; note = 2'-O-methyladenosine-3'-phosphate
  modified_base 6: mod_base = OTHER; note = 2'-O-methyluridine-3'-phosphate
  modified_base 7: mod_base = OTHER; note = 2'-O-methyluridine-3'-phosphate
  modified_base 8: mod_base = OTHER; note = 2'-O-methyluridine-3'-phosphate
  modified_base 9: mod_base = OTHER; note = 2'-O-methylguanosine-3'-phosphate
  modified_base 10: mod_base = OTHER; note = 2'-O-methyladenosine-3'-phosphate
  modified_base 12: mod_base = OTHER; note = 2'-O-methylcytidine-3'-phosphate
  modified_base 13: mod_base = OTHER; note = 2'-O-methyladenosine-3'-phosphate
  modified_base 14: mod_base = OTHER; note = 2'-O-methylguanosine-3'-phosphate
  modified_base 15: mod_base = OTHER; note = 2'-O-methyluridine-3'-phosphate
  modified_base 16: mod_base = OTHER; note = 2'-O-methylcytidine-3'-phosphate
  modified_base 18: mod_base = OTHER; note = 2'-O-methyluridine-3'-phosphate
  modified_base 19: mod_base = OTHER; note = 2'-O-methyluridine-3'-phosphate
  modified_base 20: mod_base = OTHER; note = 2'-O-methyluridine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
  misc_feature 1..10: note = RNA
  misc_feature 12..16: note = RNA
  misc_feature 18..21: note = RNA
  misc_feature 11: note = DNA
  misc_feature 17: note = DNA
acatatttgatcagtcttttt

SEQ ID NO: 23 - DNA, 21 bp, synthetic construct
  source 1..21: mol_type = other DNA
  modified_base 1: mod_base = OTHER; note = 2'-O-methyladenosine-3'-phosphorothioate
  modified_base 2: mod_base = OTHER; note = 2'-O-methylcytidine-3'-phosphorothioate
  modified_base 3: mod_base = OTHER; note = 2'-O-methyladenosine-3'-phosphate
  modified_base 4: mod_base = OTHER; note = 2'-O-methyluridine-3'-phosphate
  modified_base 5: mod_base = OTHER; note = 2'-O-methyladenosine-3'-phosphate
  modified_base 6: mod_base = OTHER; note = 2'-O-methyluridine-3'-phosphate
  modified_base 7: mod_base = OTHER; note = 2'-O-methyluridine-3'-phosphate
  modified_base 8: mod_base = OTHER; note = 2'-O-methyluridine-3'-phosphate
  modified_base 9: mod_base = OTHER; note = 2'-O-methylguanosine-3'-phosphate
  modified_base 10: mod_base = OTHER; note = 2'-O-methyladenosine-3'-phosphate
  modified_base 12: mod_base = OTHER; note = 2'-O-methylcytidine-3'-phosphate
  modified_base 13: mod_base = OTHER; note = 2'-O-methyladenosine-3'-phosphate
  modified_base 14: mod_base = OTHER; note = 2'-O-methylguanosine-3'-phosphate
  modified_base 15: mod_base = OTHER; note = 2'-O-methyluridine-3'-phosphate
  modified_base 16: mod_base = OTHER; note = 2'-O-methylcytidine-3'-phosphate
  modified_base 18: mod_base = OTHER; note = 2'-O-methyluridine-3'-phosphate
  modified_base 19: mod_base = OTHER; note = 2'-O-methyluridine-3'-phosphate
  modified_base 20: mod_base = OTHER; note = 2'-O-methyluridine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
  misc_feature 1..10: note = RNA
  misc_feature 12..16: note = RNA
  misc_feature 18..21: note = RNA
  misc_feature 11: note = DNA
  misc_feature 17: note = DNA
acatatttgatcagtcgtttt

SEQ ID NO: 24 - DNA, 21 bp, synthetic construct
  source 1..21: mol_type = other DNA
  modified_base 1: mod_base = OTHER; note = 2'-O-methyladenosine-3'-phosphorothioate
  modified_base 2: mod_base = OTHER; note = 2'-O-methylcytidine-3'-phosphorothioate
  modified_base 3: mod_base = OTHER; note = 2'-O-methyladenosine-3'-phosphate
  modified_base 4: mod_base = OTHER; note = 2'-O-methyluridine-3'-phosphate
  modified_base 5: mod_base = OTHER; note = 2'-O-methyladenosine-3'-phosphate
  modified_base 6: mod_base = OTHER; note = 2'-O-methyluridine-3'-phosphate
  modified_base 7: mod_base = OTHER; note = 2'-O-methyluridine-3'-phosphate
  modified_base 8: mod_base = OTHER; note = 2'-O-methyluridine-3'-phosphate
  modified_base 9: mod_base = OTHER; note = 2'-O-methylguanosine-3'-phosphate
  modified_base 10: mod_base = OTHER; note = 2'-O-methyladenosine-3'-phosphate
  modified_base 12: mod_base = OTHER; note = 2'-O-methylcytidine-3'-phosphate
  modified_base 13: mod_base = OTHER; note = 2'-O-methyladenosine-3'-phosphate
  modified_base 14: mod_base = OTHER; note = 2'-O-methylguanosine-3'-phosphate
  modified_base 15: mod_base = OTHER; note = 2'-O-methyluridine-3'-phosphate
  modified_base 16: mod_base = OTHER; note = 2'-O-methylcytidine-3'-phosphate
  modified_base 18: mod_base = OTHER; note = 2'-O-methyluridine-3'-phosphate
  modified_base 19: mod_base = OTHER; note = 2'-O-methyluridine-3'-phosphate
  modified_base 20: mod_base = OTHER; note = 2'-O-methyluridine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
  misc_feature 1..10: note = RNA
  misc_feature 12..16: note = RNA
  misc_feature 18..21: note = RNA
  misc_feature 11: note = DNA
  misc_feature 17: note = DNA
acatatttgatcagtcctttt

SEQ ID NO: 25 - DNA, 21 bp, synthetic construct
  source 1..21: mol_type = other DNA
  modified_base 1: mod_base = OTHER; note = 2'-O-methyladenosine-3'-phosphorothioate
  modified_base 2: mod_base = OTHER; note = 2'-O-methylcytidine-3'-phosphorothioate
  modified_base 3: mod_base = OTHER; note = 2'-O-methyladenosine-3'-phosphate
  modified_base 4: mod_base = OTHER; note = 2'-O-methyluridine-3'-phosphate
  modified_base 5: mod_base = OTHER; note = 2'-O-methyladenosine-3'-phosphate
  modified_base 6: mod_base = OTHER; note = 2'-O-methyluridine-3'-phosphate
  modified_base 7: mod_base = OTHER; note = 2'-O-methyluridine-3'-phosphate
  modified_base 8: mod_base = OTHER; note = 2'-O-methyluridine-3'-phosphate
  modified_base 9: mod_base = OTHER; note = 2'-O-methylguanosine-3'-phosphate
  modified_base 10: mod_base = OTHER; note = 2'-O-methyladenosine-3'-phosphate
  modified_base 12: mod_base = OTHER; note = 2'-O-methylcytidine-3'-phosphate
  modified_base 13: mod_base = OTHER; note = 2'-O-methyladenosine-3'-phosphate
  modified_base 14: mod_base = OTHER; note = 2'-O-methylguanosine-3'-phosphate
  modified_base 15: mod_base = OTHER; note = 2'-O-methyluridine-3'-phosphate
  modified_base 16: mod_base = OTHER; note = 2'-O-methylcytidine-3'-phosphate
  modified_base 18: mod_base = OTHER; note = 2'-O-methyluridine-3'-phosphate
  modified_base 19: mod_base = OTHER; note = 2'-O-methyluridine-3'-phosphate
  modified_base 20: mod_base = OTHER; note = 2'-O-methyluridine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
  misc_feature 1..10: note = RNA
  misc_feature 12..16: note = RNA
  misc_feature 18..21: note = RNA
  misc_feature 11: note = DNA
  misc_feature 17: note = DNA
acatatttgatcagtcatttt

SEQ ID NO: 26 - RNA, 21 nt, synthetic construct
  source 1..21: mol_type = other RNA
  modified_base 1: mod_base = OTHER; note = 2'-deoxy-2'-fluoroguanosine-3'-phosphorothioate
  modified_base 2: mod_base = OTHER; note = 2'-O-methylcytidine-3'-phosphorothioate
  modified_base 3: mod_base = OTHER; note = 2'-deoxy-2'-fluorouridine-3'-phosphate
  modified_base 4: mod_base = OTHER; note = 2'-O-methyluridine-3'-phosphate
  modified_base 5: mod_base = OTHER; note = 2'-deoxy-2'-fluoroadenosine-3'-phosphate
  modified_base 6: mod_base = OTHER; note = 2'-O-methyladenosine-3'-phosphate
  modified_base 7: mod_base = OTHER; note = 2'-deoxy-2'-fluoroadenosine-3'-phosphate
  modified_base 8: mod_base = OTHER; note = 2'-O-methyladenosine-3'-phosphate
  modified_base 9: mod_base = OTHER; note = 2'-deoxy-2'-fluoroguanosine-3'-phosphate
  modified_base 10: mod_base = OTHER; note = 2'-deoxy-2'-fluoroguanosine-3'-phosphate
  modified_base 11: mod_base = OTHER; note = 2'-deoxy-2'-fluoroguanosine-3'-phosphate
  modified_base 12: mod_base = OTHER; note = 2'-O-methyladenosine-3'-phosphate
  modified_base 13: mod_base = OTHER; note = 2'-deoxy-2'-fluorocytidine-3'-phosphate
  modified_base 14: mod_base = OTHER; note = 2'-O-methyladenosine-3'-phosphate
  modified_base 15: mod_base = OTHER; note = 2'-deoxy-2'-fluoroguanosine-3'-phosphate
  modified_base 16: mod_base = OTHER; note = 2'-O-methyluridine-3'-phosphate
  modified_base 17: mod_base = OTHER; note = 2'-deoxy-2'-fluoroadenosine-3'-phosphate
  modified_base 18: mod_base = OTHER; note = 2'-O-methyluridine-3'-phosphate
  modified_base 19: mod_base = OTHER; note = 2'-deoxy-2'-fluorouridine-3'-phosphate
  modified_base 20: mod_base = OTHER; note = 2'-O-methylcytidine-3'-phosphate
  modified_base 21: mod_base = OTHER; note = 2'-deoxy-2'-fluorouridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
gcttaaaagggacagtattct

SEQ ID NO: 27 - DNA, 21 bp, synthetic construct
  source 1..21: mol_type = other DNA
  modified_base 1: mod_base = OTHER; note = 2'-O-methylguanosine-3'-phosphorothioate
  modified_base 2: mod_base = OTHER; note = 2'-O-methylcytidine-3'-phosphorothioate
  modified_base 3: mod_base = OTHER; note = 2'-O-methyluridine-3'-phosphate
  modified_base 4: mod_base = OTHER; note = 2'-O-methyluridine-3'-phosphate
  modified_base 5: mod_base = OTHER; note = 2'-O-methyladenosine-3'-phosphate
  modified_base 6: mod_base = OTHER; note = 2'-O-methyladenosine-3'-phosphate
  modified_base 7: mod_base = OTHER; note = 2'-O-methyladenosine-3'-phosphate
  modified_base 8: mod_base = OTHER; note = 2'-O-methyladenosine-3'-phosphate
  modified_base 9: mod_base = OTHER; note = 2'-O-methylguanosine-3'-phosphate
  modified_base 10: mod_base = OTHER; note = 2'-O-methylguanosine-3'-phosphate
  modified_base 12: mod_base = OTHER; note = 2'-O-methyladenosine-3'-phosphate
  modified_base 13: mod_base = OTHER; note = 2'-O-methylcytidine-3'-phosphate
  modified_base 14: mod_base = OTHER; note = 2'-O-methyladenosine-3'-phosphate
  modified_base 15: mod_base = OTHER; note = 2'-O-methylguanosine-3'-phosphate
  modified_base 16: mod_base = OTHER; note = 2'-O-methyluridine-3'-phosphate
  modified_base 17: mod_base = OTHER; note = 2'-O-methyladenosine-3'-phosphate
  modified_base 18: mod_base = OTHER; note = 2'-O-methyluridine-3'-phosphate
  modified_base 19: mod_base = OTHER; note = 2'-O-methyluridine-3'-phosphate
  modified_base 20: mod_base = OTHER; note = 2'-O-methylcytidine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
  misc_feature 1..10: note = RNA
  misc_feature 12..21: note = RNA
  misc_feature 11: note = DNA
gcttaaaagggacagtattct

SEQ ID NO: 28 - DNA, 21 bp, synthetic construct
  source 1..21: mol_type = other DNA
  modified_base 1: mod_base = OTHER; note = 2'-O-methylguanosine-3'-phosphorothioate
  modified_base 2: mod_base = OTHER; note = 2'-O-methylcytidine-3'-phosphorothioate
  modified_base 3: mod_base = OTHER; note = 2'-O-methyluridine-3'-phosphate
  modified_base 4: mod_base = OTHER; note = 2'-O-methyluridine-3'-phosphate
  modified_base 5: mod_base = OTHER; note = 2'-O-methyladenosine-3'-phosphate
  modified_base 6: mod_base = OTHER; note = 2'-O-methyladenosine-3'-phosphate
  modified_base 7: mod_base = OTHER; note = 2'-O-methyladenosine-3'-phosphate
  modified_base 8: mod_base = OTHER; note = 2'-O-methyladenosine-3'-phosphate
  modified_base 9: mod_base = OTHER; note = 2'-O-methylguanosine-3'-phosphate
  modified_base 10: mod_base = OTHER; note = 2'-O-methylguanosine-3'-phosphate
  modified_base 12: mod_base = OTHER; note = 2'-O-methyladenosine-3'-phosphate
  modified_base 13: mod_base = OTHER; note = 2'-O-methylcytidine-3'-phosphate
  modified_base 14: mod_base = OTHER; note = 2'-O-methyladenosine-3'-phosphate
  modified_base 15: mod_base = OTHER; note = 2'-O-methylguanosine-3'-phosphate
  modified_base 16: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methyluridine-3'-phosphate
  modified_base 20: mod_base = OTHER; note = 2'-O-methylcytidine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
  misc_feature 1..10: note = RNA
  misc_feature 12..16: note = RNA
  misc_feature 18..21: note = RNA
  misc_feature 11: note = DNA
  misc_feature 17: note = DNA
gcttaaaagggacagtattct

SEQ ID NO: 29 - DNA, 21 bp, synthetic construct
  source 1..21: mol_type = other DNA
  modified_base 1: mod_base = OTHER; note = 2'-O-methylguanosine-3'-phosphorothioate
  modified_base 2: mod_base = OTHER; note = 2'-O-methylcytidine-3'-phosphorothioate
  modified_base 3: mod_base = OTHER; note = 2'-O-methyluridine-3'-phosphate
  modified_base 4: mod_base = OTHER; note = 2'-O-methyluridine-3'-phosphate
  modified_base 5: mod_base = OTHER; note = 2'-O-methyladenosine-3'-phosphate
  modified_base 6: mod_base = OTHER; note = 2'-O-methyladenosine-3'-phosphate
  modified_base 7: mod_base = OTHER; note = 2'-O-methyladenosine-3'-phosphate
  modified_base 8: mod_base = OTHER; note = 2'-O-methyladenosine-3'-phosphate
  modified_base 9: mod_base = OTHER; note = 2'-O-methylguanosine-3'-phosphate
  modified_base 10: mod_base = OTHER; note = 2'-O-methylguanosine-3'-phosphate
  modified_base 12: mod_base = OTHER; note = 2'-O-methyladenosine-3'-phosphate
  modified_base 13: mod_base = OTHER; note = 2'-O-methylcytidine-3'-phosphate
  modified_base 14: mod_base = OTHER; note = 2'-O-methyladenosine-3'-phosphate
  modified_base 15: mod_base = OTHER; note = 2'-O-methylguanosine-3'-phosphate
  modified_base 16: mod_base = OTHER; note = 2'-O-methyluridine-3'-phosphate
  modified_base 17: mod_base = OTHER; note = Adenosine-glycol nucleic acid (GNA), S-isomer
  modified_base 18: mod_base = OTHER; note = 2'-O-methyluridine-3'-phosphate
  modified_base 19: mod_base = OTHER; note = 2'-O-methyluridine-3'-phosphate
  modified_base 20: mod_base = OTHER; note = 2'-O-methylcytidine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
  misc_feature 1..10: note = RNA
  misc_feature 12..21: note = RNA
  misc_feature 11: note = DNA
gcttaaaagggacagtattct

SEQ ID NO: 30 - DNA, 21 bp, synthetic construct
  source 1..21: mol_type = other DNA
  modified_base 1: mod_base = OTHER; note = 2'-O-methylguanosine-3'-phosphorothioate
  modified_base 2: mod_base = OTHER; note = 2'-O-methylcytidine-3'-phosphorothioate
  modified_base 3: mod_base = OTHER; note = 2'-O-methyluridine-3'-phosphate
  modified_base 4: mod_base = OTHER; note = 2'-O-methyluridine-3'-phosphate
  modified_base 5: mod_base = OTHER; note = 2'-O-methyladenosine-3'-phosphate
  modified_base 6: mod_base = OTHER; note = 2'-O-methyladenosine-3'-phosphate
  modified_base 7: mod_base = OTHER; note = 2'-O-methyladenosine-3'-phosphate
  modified_base 8: mod_base = OTHER; note = 2'-O-methyladenosine-3'-phosphate
  modified_base 9: mod_base = OTHER; note = 2'-O-methylguanosine-3'-phosphate
  modified_base 10: mod_base = OTHER; note = 2'-O-methylguanosine-3'-phosphate
  modified_base 12: mod_base = OTHER; note = 2'-O-methyladenosine-3'-phosphate
  modified_base 13: mod_base = OTHER; note = 2'-O-methylcytidine-3'-phosphate
  modified_base 14: mod_base = OTHER; note = 2'-O-methyladenosine-3'-phosphate
  modified_base 15: mod_base = OTHER; note = 2'-O-methylguanosine-3'-phosphate
  modified_base 16: mod_base = OTHER; note = 2'-O-methyluridine-3'-phosphate
  modified_base 17: mod_base = OTHER; note = 2'-O-methylguanosine-3'-phosphate
  modified_base 18: mod_base = OTHER; note = 2'-O-methyluridine-3'-phosphate
  modified_base 19: mod_base = OTHER; note = 2'-O-methyluridine-3'-phosphate
  modified_base 20: mod_base = OTHER; note = 2'-O-methylcytidine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
  misc_feature 1..10: note = RNA
  misc_feature 12..21: note = RNA
  misc_feature 11: note = DNA
gcttaaaagggacagtgttct

SEQ ID NO: 31 - DNA, 21 bp, synthetic construct
  source 1..21: mol_type = other DNA
  modified_base 1: mod_base = OTHER; note = 2'-O-methylguanosine-3'-phosphorothioate
  modified_base 2: mod_base = OTHER; note = 2'-O-methylcytidine-3'-phosphorothioate
  modified_base 3: mod_base = OTHER; note = 2'-O-methyluridine-3'-phosphate
  modified_base 4: mod_base = OTHER; note = 2'-O-methyluridine-3'-phosphate
  modified_base 5: mod_base = OTHER; note = 2'-O-methyladenosine-3'-phosphate
  modified_base 6: mod_base = OTHER; note = 2'-O-methyladenosine-3'-phosphate
  modified_base 7: mod_base = OTHER; note = 2'-O-methyladenosine-3'-phosphate
  modified_base 8: mod_base = OTHER; note = 2'-O-methyladenosine-3'-phosphate
  modified_base 9: mod_base = OTHER; note = 2'-O-methylguanosine-3'-phosphate
  modified_base 10: mod_base = OTHER; note = 2'-O-methylguanosine-3'-phosphate
  modified_base 12: mod_base = OTHER; note = 2'-O-methyladenosine-3'-phosphate
  modified_base 13: mod_base = OTHER; note = 2'-O-methylcytidine-3'-phosphate
  modified_base 14: mod_base = OTHER; note = 2'-O-methyladenosine-3'-phosphate
  modified_base 15: mod_base = OTHER; note = 2'-O-methylguanosine-3'-phosphate
  modified_base 16: mod_base = OTHER; note = 2'-O-methyluridine-3'-phosphate
  modified_base 17: mod_base = OTHER; note = 2'-O-methylcytidine-3'-phosphate
  modified_base 18: mod_base = OTHER; note = 2'-O-methyluridine-3'-phosphate
  modified_base 19: mod_base = OTHER; note = 2'-O-methyluridine-3'-phosphate
  modified_base 20: mod_base = OTHER; note = 2'-O-methylcytidine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
  misc_feature 1..10: note = RNA
  misc_feature 12..21: note = RNA
  misc_feature 11: note = DNA
gcttaaaagggacagtcttct

SEQ ID NO: 32 - DNA, 21 bp, synthetic construct
  source 1..21: mol_type = other DNA
  modified_base 1: mod_base = OTHER; note = 2'-O-methylguanosine-3'-phosphorothioate
  modified_base 2: mod_base = OTHER; note = 2'-O-methylcytidine-3'-phosphorothioate
  modified_base 3: mod_base = OTHER; note = 2'-O-methyluridine-3'-phosphate
  modified_base 4: mod_base = OTHER; note = 2'-O-methyluridine-3'-phosphate
  modified_base 5: mod_base = OTHER; note = 2'-O-methyladenosine-3'-phosphate
  modified_base 6: mod_base = OTHER; note = 2'-O-methyladenosine-3'-phosphate
  modified_base 7: mod_base = OTHER; note = 2'-O-methyladenosine-3'-phosphate
  modified_base 8: mod_base = OTHER; note = 2'-O-methyladenosine-3'-phosphate
  modified_base 9: mod_base = OTHER; note = 2'-O-methylguanosine-3'-phosphate
  modified_base 10: mod_base = OTHER; note = 2'-O-methylguanosine-3'-phosphate
  modified_base 12: mod_base = OTHER; note = 2'-O-methyladenosine-3'-phosphate
  modified_base 13: mod_base = OTHER; note = 2'-O-methylcytidine-3'-phosphate
  modified_base 14: mod_base = OTHER; note = 2'-O-methyladenosine-3'-phosphate
  modified_base 15: mod_base = OTHER; note = 2'-O-methylguanosine-3'-phosphate
  modified_base 16: mod_base = OTHER; note = 2'-O-methyluridine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methyluridine-3'-phosphate
  modified_base 20: mod_base = OTHER; note = 2'-O-methylcytidine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
  misc_feature 1..10: note = RNA
  misc_feature 12..21: note = RNA
  misc_feature 11: note = DNA
gcttaaaagggacagttttct

SEQ ID NO: 33 - DNA, 21 bp, synthetic construct
  source 1..21: mol_type = other DNA
  modified_base 1: mod_base = OTHER; note = 2'-O-methylguanosine-3'-phosphorothioate
  modified_base 2: mod_base = OTHER; note = 2'-O-methylcytidine-3'-phosphorothioate
  modified_base 3: mod_base = OTHER; note = 2'-O-methyluridine-3'-phosphate
  modified_base 4: mod_base = OTHER; note = 2'-O-methyluridine-3'-phosphate
  modified_base 5: mod_base = OTHER; note = 2'-O-methyladenosine-3'-phosphate
  modified_base 6: mod_base = OTHER; note = 2'-O-methyladenosine-3'-phosphate
  modified_base 7: mod_base = OTHER; note = 2'-O-methyladenosine-3'-phosphate
  modified_base 8: mod_base = OTHER; note = 2'-O-methyladenosine-3'-phosphate
  modified_base 9: mod_base = OTHER; note = 2'-O-methylguanosine-3'-phosphate
  modified_base 10: mod_base = OTHER; note = 2'-O-methylguanosine-3'-phosphate
  modified_base 12: mod_base = OTHER; note = 2'-O-methyladenosine-3'-phosphate
  modified_base 13: mod_base = OTHER; note = 2'-O-methylcytidine-3'-phosphate
  modified_base 14: mod_base = OTHER; note = 2'-O-methyladenosine-3'-phosphate
  modified_base 15: mod_base = OTHER; note = 2'-O-methylguanosine-3'-phosphate
  modified_base 16: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methyluridine-3'-phosphate
  modified_base 20: mod_base = OTHER; note = 2'-O-methylcytidine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
  misc_feature 1..10: note = RNA
  misc_feature 12..16: note = RNA
  misc_feature 18..21: note = RNA
  misc_feature 11: note = DNA
  misc_feature 17: note = DNA
gcttaaaagggacagttttct

SEQ ID NO: 34 - RNA, 21 nt, synthetic construct
  source 1..21: mol_type = other RNA
  modified_base 1: mod_base = OTHER; note = 2'-deoxy-2'-fluorouridine-3'-phosphorothioate
  modified_base 2: mod_base = OTHER; note = 2'-O-methylguanosine-3'-phosphorothioate
  modified_base 3: mod_base = OTHER; note = 2'-deoxy-2'-fluoroguanosine-3'-phosphate
  modified_base 4: mod_base = OTHER; note = 2'-O-methylguanosine-3'-phosphate
  modified_base 5: mod_base = OTHER; note = 2'-deoxy-2'-fluoroadenosine-3'-phosphate
  modified_base 6: mod_base = OTHER; note = 2'-O-methyluridine-3'-phosphate
  modified_base 7: mod_base = OTHER; note = 2'-deoxy-2'-fluorouridine-3'-phosphate
  modified_base 8: mod_base = OTHER; note = 2'-O-methyluridine-3'-phosphate
  modified_base 9: mod_base = OTHER; note = 2'-deoxy-2'-fluorocytidine-3'-phosphate
  modified_base 10: mod_base = OTHER; note = 2'-deoxy-2'-fluoroadenosine-3'-phosphate
  modified_base 11: mod_base = OTHER; note = 2'-deoxy-2'-fluorouridine-3'-phosphate
  modified_base 12: mod_base = OTHER; note = 2'-O-methylguanosine-3'-phosphate
  modified_base 13: mod_base = OTHER; note = 2'-deoxy-2'-fluorouridine-3'-phosphate
  modified_base 14: mod_base = OTHER; note = 2'-O-methyladenosine-3'-phosphate
  modified_base 15: mod_base = OTHER; note = 2'-deoxy-2'-fluoroadenosine-3'-phosphate
  modified_base 16: mod_base = OTHER; note = 2'-O-methylcytidine-3'-phosphate
  modified_base 17: mod_base = OTHER; note = 2'-deoxy-2'-fluorocytidine-3'-phosphate
  modified_base 18: mod_base = OTHER; note = 2'-O-methyladenosine-3'-phosphate
  modified_base 19: mod_base = OTHER; note = 2'-deoxy-2'-fluoroadenosine-3'-phosphate
  modified_base 20: mod_base = OTHER; note = 2'-O-methylguanosine-3'-phosphate
  modified_base 21: mod_base = OTHER; note = 2'-deoxy-2'-fluoroadenosine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
tgggatttcatgtaaccaaga

SEQ ID NO: 35 - DNA, 21 bp, synthetic construct
  source 1..21: mol_type = other DNA
  modified_base 1: mod_base = OTHER; note = 2'-O-methyluridine-3'-phosphorothioate
  modified_base 2: mod_base = OTHER; note = 2'-O-methylguanosine-3'-phosphorothioate
  modified_base 3: mod_base = OTHER; note = 2'-O-methylguanosine-3'-phosphate
  modified_base 4: mod_base = OTHER; note = 2'-O-methylguanosine-3'-phosphate
  modified_base 5: mod_base = OTHER; note = 2'-O-methyladenosine-3'-phosphate
  modified_base 6: mod_base = OTHER; note = 2'-O-methyluridine-3'-phosphate
  modified_base 7: mod_base = OTHER; note = 2'-O-methyluridine-3'-phosphate
  modified_base 8: mod_base = OTHER; note = 2'-O-methyluridine-3'-phosphate
  modified_base 9: mod_base = OTHER; note = 2'-O-methylcytidine-3'-phosphate
  modified_base 10: mod_base = OTHER; note = 2'-O-methyladenosine-3'-phosphate
  modified_base 12: mod_base = OTHER; note = 2'-O-methylguanosine-3'-phosphate
  modified_base 13: mod_base = OTHER; note = 2'-O-methyluridine-3'-phosphate
  modified_base 14: mod_base = OTHER; note = 2'-O-methyladenosine-3'-phosphate
  modified_base 15: mod_base = OTHER; note = 2'-O-methyladenosine-3'-phosphate
  modified_base 16: mod_base = OTHER; note = 2'-O-methylcytidine-3'-phosphate
  modified_base 17: mod_base = OTHER; note = 2'-O-methylcytidine-3'-phosphate
  modified_base 18: mod_base = OTHER; note = 2'-O-methyladenosine-3'-phosphate
  modified_base 19: mod_base = OTHER; note = 2'-O-methyladenosine-3'-phosphate
  modified_base 20: mod_base = OTHER; note = 2'-O-methylguanosine-3'-phosphate
  modified_base 21: mod_base = OTHER; note = 2'-O-methyladenosine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
  misc_feature 1..10: note = RNA
  misc_feature 12..21: note = RNA
  misc_feature 11: note = DNA
tgggatttcatgtaaccaaga

SEQ ID NO: 36 - DNA, 21 bp, synthetic construct
  source 1..21: mol_type = other DNA
  modified_base 1: mod_base = OTHER; note = 2'-O-methyluridine-3'-phosphorothioate
  modified_base 2: mod_base = OTHER; note = 2'-O-methylguanosine-3'-phosphorothioate
  modified_base 3: mod_base = OTHER; note = 2'-O-methylguanosine-3'-phosphate
  modified_base 4: mod_base = OTHER; note = 2'-O-methylguanosine-3'-phosphate
  modified_base 5: mod_base = OTHER; note = 2'-O-methyladenosine-3'-phosphate
  modified_base 6: mod_base = OTHER; note = 2'-O-methyluridine-3'-phosphate
  modified_base 7: mod_base = OTHER; note = 2'-O-methyluridine-3'-phosphate
  modified_base 8: mod_base = OTHER; note = 2'-O-methyluridine-3'-phosphate
  modified_base 9: mod_base = OTHER; note = 2'-O-methylcytidine-3'-phosphate
  modified_base 10: mod_base = OTHER; note = 2'-O-methyladenosine-3'-phosphate
  modified_base 12: mod_base = OTHER; note = 2'-O-methylguanosine-3'-phosphate
  modified_base 13: mod_base = OTHER; note = 2'-O-methyluridine-3'-phosphate
  modified_base 14: mod_base = OTHER; note = 2'-O-methyladenosine-3'-phosphate
  modified_base 15: mod_base = OTHER; note = 2'-O-methyladenosine-3'-phosphate
  modified_base 16: mod_base = OTHER; note = 2'-O-methylcytidine-3'-phosphate
  modified_base 18: mod_base = OTHER; note = 2'-O-methyladenosine-3'-phosphate
  modified_base 19: mod_base = OTHER; note = 2'-O-methyladenosine-3'-phosphate
  modified_base 20: mod_base = OTHER; note = 2'-O-methylguanosine-3'-phosphate
  modified_base 21: mod_base = OTHER; note = 2'-O-methyladenosine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
  misc_feature 1..10: note = RNA
  misc_feature 12..16: note = RNA
  misc_feature 18..21: note = RNA
  misc_feature 11: note = DNA
  misc_feature 17: note = DNA
tgggatttcatgtaaccaaga

SEQ ID NO: 37 - DNA, 21 bp, synthetic construct
  source 1..21: mol_type = other DNA
  modified_base 1: mod_base = OTHER; note = 2'-O-methyluridine-3'-phosphorothioate
  modified_base 2: mod_base = OTHER; note = 2'-O-methylguanosine-3'-phosphorothioate
  modified_base 3: mod_base = OTHER; note = 2'-O-methylguanosine-3'-phosphate
  modified_base 4: mod_base = OTHER; note = 2'-O-methylguanosine-3'-phosphate
  modified_base 5: mod_base = OTHER; note = 2'-O-methyladenosine-3'-phosphate
  modified_base 6: mod_base = OTHER; note = 2'-O-methyluridine-3'-phosphate
  modified_base 7: mod_base = OTHER; note = 2'-O-methyluridine-3'-phosphate
  modified_base 8: mod_base = OTHER; note = 2'-O-methyluridine-3'-phosphate
  modified_base 9: mod_base = OTHER; note = 2'-O-methylcytidine-3'-phosphate
  modified_base 10: mod_base = OTHER; note = 2'-O-methyladenosine-3'-phosphate
  modified_base 12: mod_base = OTHER; note = 2'-O-methylguanosine-3'-phosphate
  modified_base 13: mod_base = OTHER; note = 2'-O-methyluridine-3'-phosphate
  modified_base 14: mod_base = OTHER; note = 2'-O-methyladenosine-3'-phosphate
  modified_base 15: mod_base = OTHER; note = 2'-O-methyladenosine-3'-phosphate
  modified_base 16: mod_base = OTHER; note = 2'-O-methylcytidine-3'-phosphate
  modified_base 17: mod_base = OTHER; note = Cytidine-glycol nucleic acid (GNA), S-isomer
  modified_base 18: mod_base = OTHER; note = 2'-O-methyladenosine-3'-phosphate
  modified_base 19: mod_base = OTHER; note = 2'-O-methyladenosine-3'-phosphate
  modified_base 20: mod_base = OTHER; note = 2'-O-methylguanosine-3'-phosphate
  modified_base 21: mod_base = OTHER; note = 2'-O-methyladenosine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
  misc_feature 1..10: note = RNA
  misc_feature 12..21: note = RNA
  misc_feature 11: note = DNA
tgggatttcatgtaaccaaga

SEQ ID NO: 38 - DNA, 21 bp, synthetic construct
  source 1..21: mol_type = other DNA
  modified_base 1: mod_base = OTHER; note = 2'-O-methyluridine-3'-phosphorothioate
  modified_base 2: mod_base = OTHER; note = 2'-O-methylguanosine-3'-phosphorothioate
  modified_base 3: mod_base = OTHER; note = 2'-O-methylguanosine-3'-phosphate
  modified_base 4: mod_base = OTHER; note = 2'-O-methylguanosine-3'-phosphate
  modified_base 5: mod_base = OTHER; note = 2'-O-methyladenosine-3'-phosphate
  modified_base 6: mod_base = OTHER; note = 2'-O-methyluridine-3'-phosphate
  modified_base 7: mod_base = OTHER; note = 2'-O-methyluridine-3'-phosphate
  modified_base 8: mod_base = OTHER; note = 2'-O-methyluridine-3'-phosphate
  modified_base 9: mod_base = OTHER; note = 2'-O-methylcytidine-3'-phosphate
  modified_base 10: mod_base = OTHER; note = 2'-O-methyladenosine-3'-phosphate
  modified_base 12: mod_base = OTHER; note = 2'-O-methylguanosine-3'-phosphate
  modified_base 13: mod_base = OTHER; note = 2'-O-methyluridine-3'-phosphate
  modified_base 14: mod_base = OTHER; note = 2'-O-methyladenosine-3'-phosphate
  modified_base 15: mod_base = OTHER; note = 2'-O-methyladenosine-3'-phosphate
  modified_base 16: mod_base = OTHER; note = 2'-O-methylcytidine-3'-phosphate
  modified_base 17: mod_base = OTHER; note = 2'-O-methyluridine-3'-phosphate
  modified_base 18: mod_base = OTHER; note = 2'-O-methyladenosine-3'-phosphate
  modified_base 19: mod_base = OTHER; note = 2'-O-methyladenosine-3'-phosphate
  modified_base 20: mod_base = OTHER; note = 2'-O-methylguanosine-3'-phosphate
  modified_base 21: mod_base = OTHER; note = 2'-O-methyladenosine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
  misc_feature 1..10: note = RNA
  misc_feature 12..21: note = RNA
  misc_feature 11: note = DNA
tgggatttcatgtaactaaga

SEQ ID NO: 39 - DNA, 21 bp, synthetic construct
  source 1..21: mol_type = other DNA
  modified_base 1: mod_base = OTHER; note = 2'-O-methyluridine-3'-phosphorothioate
  modified_base 2: mod_base = OTHER; note = 2'-O-methylguanosine-3'-phosphorothioate
  modified_base 3: mod_base = OTHER; note = 2'-O-methylguanosine-3'-phosphate
  modified_base 4: mod_base = OTHER; note = 2'-O-methylguanosine-3'-phosphate
  modified_base 5: mod_base = OTHER; note = 2'-O-methyladenosine-3'-phosphate
  modified_base 6: mod_base = OTHER; note = 2'-O-methyluridine-3'-phosphate
  modified_base 7: mod_base = OTHER; note = 2'-O-methyluridine-3'-phosphate
  modified_base 8: mod_base = OTHER; note = 2'-O-methyluridine-3'-phosphate
  modified_base 9: mod_base = OTHER; note = 2'-O-methylcytidine-3'-phosphate
  modified_base 10: mod_base = OTHER; note = 2'-O-methyladenosine-3'-phosphate
  modified_base 12: mod_base = OTHER; note = 2'-O-methylguanosine-3'-phosphate
  modified_base 13: mod_base = OTHER; note = 2'-O-methyluridine-3'-phosphate
  modified_base 14: mod_base = OTHER; note = 2'-O-methyladenosine-3'-phosphate
  modified_base 15: mod_base = OTHER; note = 2'-O-methyladenosine-3'-phosphate
  modified_base 16: mod_base = OTHER; note = 2'-O-methylcytidine-3'-phosphate
  modified_base 17: mod_base = OTHER; note = 2'-O-methyladenosine-3'-phosphate
  modified_base 18: mod_base = OTHER; note = 2'-O-methyladenosine-3'-phosphate
  modified_base 19: mod_base = OTHER; note = 2'-O-methyladenosine-3'-phosphate
  modified_base 20: mod_base = OTHER; note = 2'-O-methylguanosine-3'-phosphate
  modified_base 21: mod_base = OTHER; note = 2'-O-methyladenosine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
  misc_feature 1..10: note = RNA
  misc_feature 12..21: note = RNA
  misc_feature 11: note = DNA
tgggatttcatgtaacaaaga

SEQ ID NO: 40 - DNA, 21 bp, synthetic construct
  source 1..21: mol_type = other DNA
  modified_base 1: mod_base = OTHER; note = 2'-O-methyluridine-3'-phosphorothioate
  modified_base 2: mod_base = OTHER; note = 2'-O-methylguanosine-3'-phosphorothioate
  modified_base 3: mod_base = OTHER; note = 2'-O-methylguanosine-3'-phosphate
  modified_base 4: mod_base = OTHER; note = 2'-O-methylguanosine-3'-phosphate
  modified_base 5: mod_base = OTHER; note = 2'-O-methyladenosine-3'-phosphate
  modified_base 6: mod_base = OTHER; note = 2'-O-methyluridine-3'-phosphate
  modified_base 7: mod_base = OTHER; note = 2'-O-methyluridine-3'-phosphate
  modified_base 8: mod_base = OTHER; note = 2'-O-methyluridine-3'-phosphate
  modified_base 9: mod_base = OTHER; note = 2'-O-methylcytidine-3'-phosphate
  modified_base 10: mod_base = OTHER; note = 2'-O-methyladenosine-3'-phosphate
  modified_base 12: mod_base = OTHER; note = 2'-O-methylguanosine-3'-phosphate
  modified_base 13: mod_base = OTHER; note = 2'-O-methyluridine-3'-phosphate
  modified_base 14: mod_base = OTHER; note = 2'-O-methyladenosine-3'-phosphate
  modified_base 15: mod_base = OTHER; note = 2'-O-methyladenosine-3'-phosphate
  modified_base 16: mod_base = OTHER; note = 2'-O-methylcytidine-3'-phosphate
  modified_base 17: mod_base = OTHER; note = 2'-O-methylguanosine-3'-phosphate
  modified_base 18: mod_base = OTHER; note = 2'-O-methyladenosine-3'-phosphate
  modified_base 19: mod_base = OTHER; note = 2'-O-methyladenosine-3'-phosphate
  modified_base 20: mod_base = OTHER; note = 2'-O-methylguanosine-3'-phosphate
  modified_base 21: mod_base = OTHER; note = 2'-O-methyladenosine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
  misc_feature 1..10: note = RNA
  misc_feature 12..21: note = RNA
  misc_feature 11: note = DNA
tgggatttcatgtaacgaaga

SEQ ID NO: 41 - RNA, 23 nt, synthetic construct
  source 1..23: mol_type = other RNA
  modified_base 1: mod_base = OTHER; note = 2'-O-methyluridine-3'-phosphorothioate
  modified_base 2: mod_base = OTHER; note = 2'-deoxy-2'-fluorouridine-3'-phosphorothioate
  modified_base 3: mod_base = OTHER; note = 2'-O-methyladenosine-3'-phosphate
  modified_base 4: mod_base = OTHER; note = 2'-deoxy-2'-fluorouridine-3'-phosphate
  modified_base 5: mod_base = OTHER; note = 2'-O-methyladenosine-3'-phosphate
  modified_base 6: mod_base = OTHER; note = 2'-deoxy-2'-fluoroguanosine-3'-phosphate
  modified_base 7: mod_base = OTHER; note = 2'-O-methyladenosine-3'-phosphate
  modified_base 8: mod_base = OTHER; note = 2'-deoxy-2'-fluoroguanosine-3'-phosphate
  modified_base 9: mod_base = OTHER; note = 2'-O-methylcytidine-3'-phosphate
  modified_base 10: mod_base = OTHER; note = 2'-deoxy-2'-fluoroadenosine-3'-phosphate
  modified_base 11: mod_base = OTHER; note = 2'-O-methyladenosine-3'-phosphate
  modified_base 12: mod_base = OTHER; note = 2'-O-methylguanosine-3'-phosphate
  modified_base 13: mod_base = OTHER; note = 2'-O-methyladenosine-3'-phosphate
  modified_base 14: mod_base = OTHER; note = 2'-deoxy-2'-fluoroadenosine-3'-phosphate
  modified_base 15: mod_base = OTHER; note = 2'-O-methylcytidine-3'-phosphate
  modified_base 16: mod_base = OTHER; note = 2'-deoxy-2'-fluoroadenosine-3'-phosphate
  modified_base 17: mod_base = OTHER; note = 2'-O-methylcytidine-3'-phosphate
  modified_base 18: mod_base = OTHER; note = 2'-deoxy-2'-fluorouridine-3'-phosphate
  modified_base 19: mod_base = OTHER; note = 2'-O-methylguanosine-3'-phosphate
  modified_base 20: mod_base = OTHER; note = 2'-deoxy-2'-fluorouridine-3'-phosphate
  modified_base 21: mod_base = OTHER; note = 2'-O-methyluridine-3'-phosphorothioate
  modified_base 22: mod_base = OTHER; note = 2'-O-methyluridine-3'-phosphorothioate
  modified_base 23: mod_base = OTHER; note = 2'-O-methyluridine
ttatagagcaagaacactgtttt

SEQ ID NO: 42 - RNA, 23 nt, synthetic construct
  source 1..23: mol_type = other RNA
  modified_base 1: mod_base = OTHER; note = 2'-O-methyluridine-3'-phosphorothioate
  modified_base 2: mod_base = OTHER; note = 2'-deoxy-2'-fluorouridine-3'-phosphorothioate
  modified_base 3: mod_base = OTHER; note = 2'-O-methyladenosine-3'-phosphate
  modified_base 4: mod_base = OTHER; note = 2'-deoxy-2'-fluorouridine-3'-phosphate
  modified_base 5: mod_base = OTHER; note = 2'-O-methyladenosine-3'-phosphate
  modified_base 6: mod_base = OTHER; note = 2'-deoxy-2'-fluoroguanosine-3'-phosphate
  modified_base 7: mod_base = OTHER; note = 2'-O-methyladenosine-3'-phosphate
  modified_base 8: mod_base = OTHER; note = 2'-deoxy-2'-fluoroguanosine-3'-phosphate
  modified_base 9: mod_base = OTHER; note = 2'-O-methylcytidine-3'-phosphate
  modified_base 10: mod_base = OTHER; note = 2'-deoxy-2'-fluoroadenosine-3'-phosphate
  modified_base 11: mod_base = OTHER; note = 2'-O-methyladenosine-3'-phosphate
  modified_base 12: mod_base = OTHER; note = 2'-O-methylguanosine-3'-phosphate
  modified_base 13: mod_base = OTHER; note = 2'-O-methyladenosine-3'-phosphate
  modified_base 14: mod_base = OTHER; note = 2'-deoxy-2'-fluoroadenosine-3'-phosphate
  modified_base 15: mod_base = OTHER; note = 2'-O-methylcytidine-3'-phosphate
  modified_base 16: mod_base = OTHER; note = 2'-deoxy-2'-fluoroadenosine-3'-phosphate
  modified_base 17: mod_base = OTHER; note = 2'-O-methylcytidine-3'-phosphate
  modified_base 18: mod_base = OTHER; note = 2'-deoxy-2'-fluorouridine-3'-phosphate
  modified_base 19: mod_base = OTHER; note = 2'-O-methylguanosine-3'-phosphate
  modified_base 20: mod_base = OTHER; note = 2'-deoxy-2'-fluorouridine-3'-phosphate
  modified_base 21: mod_base = OTHER; note = 2'-O-methyluridine-3'-phosphorothioate
  modified_base 22: mod_base = OTHER; note = 2'-O-methyluridine-3'-phosphorothioate
  modified_base 23: mod_base = OTHER; note = 2'-O-methyluridine
ttatagagcaagaacactgtttt

SEQ ID NO: 43 - RNA, 23 nt, synthetic construct
  source 1..23: mol_type = other RNA
  modified_base 1: mod_base = OTHER; note = 2'-O-methyluridine-3'-phosphorothioate
  modified_base 2: mod_base = OTHER; note = 2'-deoxy-2'-fluorouridine-3'-phosphorothioate
  modified_base 3: mod_base = OTHER; note = 2'-O-methyladenosine-3'-phosphate
  modified_base 4: mod_base = OTHER; note = 2'-deoxy-2'-fluorouridine-3'-phosphate
  modified_base 5: mod_base = OTHER; note = 2'-O-methyladenosine-3'-phosphate
  modified_base 6: mod_base = OTHER; note = 2'-deoxy-2'-fluoroguanosine-3'-phosphate
  modified_base 7: mod_base = OTHER; note = 2'-O-methyladenosine-3'-phosphate
  modified_base 8: mod_base = OTHER; note = 2'-deoxy-2'-fluoroguanosine-3'-phosphate
  modified_base 9: mod_base = OTHER; note = 2'-O-methylcytidine-3'-phosphate
  modified_base 10: mod_base = OTHER; note = 2'-deoxy-2'-fluoroadenosine-3'-phosphate
  modified_base 11: mod_base = OTHER; note = 2'-O-methyladenosine-3'-phosphate
  modified_base 12: mod_base = OTHER; note = 2'-O-methylguanosine-3'-phosphate
  modified_base 13: mod_base = OTHER; note = 2'-O-methyladenosine-3'-phosphate
  modified_base 14: mod_base = OTHER; note = 2'-deoxy-2'-fluoroadenosine-3'-phosphate
  modified_base 15: mod_base = OTHER; note = 2'-O-methylcytidine-3'-phosphate
  modified_base 16: mod_base = OTHER; note = 2'-deoxy-2'-fluoroadenosine-3'-phosphate
  modified_base 17: mod_base = OTHER; note = 2'-O-methylcytidine-3'-phosphate
  modified_base 18: mod_base = OTHER; note = 2'-deoxy-2'-fluorouridine-3'-phosphate
  modified_base 19: mod_base = OTHER; note = 2'-O-methylguanosine-3'-phosphate
  modified_base 20: mod_base = OTHER; note = 2'-deoxy-2'-fluorouridine-3'-phosphate
  modified_base 21: mod_base = OTHER; note = 2'-O-methyluridine-3'-phosphorothioate
  modified_base 22: mod_base = OTHER; note = 2'-O-methyluridine-3'-phosphorothioate
  modified_base 23: mod_base = OTHER; note = 2'-O-methyluridine
ttatagagcaagaacactgtttt

SEQ ID NO: 44 - RNA, 23 nt, synthetic construct
  source 1..23: mol_type = other RNA
  modified_base 1: mod_base = OTHER; note = 2'-O-methyluridine-3'-phosphorothioate
  modified_base 2: mod_base = OTHER; note = 2'-deoxy-2'-fluorouridine-3'-phosphorothioate
  modified_base 3: mod_base = OTHER; note = 2'-O-methyladenosine-3'-phosphate
  modified_base 4: mod_base = OTHER; note = 2'-deoxy-2'-fluorouridine-3'-phosphate
  modified_base 5: mod_base = OTHER; note = 2'-O-methyladenosine-3'-phosphate
  modified_base 6: mod_base = OTHER; note = 2'-deoxy-2'-fluoroguanosine-3'-phosphate
  modified_base 7: mod_base = OTHER; note = 2'-O-methyladenosine-3'-phosphate
  modified_base 8: mod_base = OTHER; note = 2'-deoxy-2'-fluoroguanosine-3'-phosphate
  modified_base 9: mod_base = OTHER; note = 2'-O-methylcytidine-3'-phosphate
  modified_base 10: mod_base = OTHER; note = 2'-deoxy-2'-fluoroadenosine-3'-phosphate
  modified_base 11: mod_base = OTHER; note = 2'-O-methyladenosine-3'-phosphate
  modified_base 12: mod_base = OTHER; note = 2'-O-methylguanosine-3'-phosphate
  modified_base 13: mod_base = OTHER; note = 2'-O-methyladenosine-3'-phosphate
  modified_base 14: mod_base = OTHER; note = 2'-deoxy-2'-fluoroadenosine-3'-phosphate
  modified_base 15: mod_base = OTHER; note = 2'-O-methylcytidine-3'-phosphate
  modified_base 16: mod_base = OTHER; note = 2'-deoxy-2'-fluoroadenosine-3'-phosphate
  modified_base 17: mod_base = OTHER; note = 2'-O-methylcytidine-3'-phosphate
  modified_base 18: mod_base = OTHER; note = 2'-deoxy-2'-fluorouridine-3'-phosphate
  modified_base 19: mod_base = OTHER; note = 2'-O-methylguanosine-3'-phosphate
  modified_base 20: mod_base = OTHER; note = 2'-deoxy-2'-fluorouridine-3'-phosphate
  modified_base 21: mod_base = OTHER; note = 2'-O-methyluridine-3'-phosphorothioate
  modified_base 22: mod_base = OTHER; note = 2'-O-methyluridine-3'-phosphorothioate
  modified_base 23: mod_base = OTHER; note = 2'-O-methyluridine
ttatagagcaagaacactgtttt

SEQ ID NO: 45 - DNA, 23 bp, synthetic construct
  source 1..23: mol_type = other DNA
  modified_base 1: mod_base = OTHER; note = 2'-O-methyluridine-3'-phosphorothioate
  modified_base 2: mod_base = OTHER; note = 2'-deoxythymidine-3'-phosphorothioate
  modified_base 3: mod_base = OTHER; note = 2'-O-methyladenosine-3'-phosphate
  modified_base 4: mod_base = OTHER; note = 2'-O-methyluridine-3'-phosphate
  modified_base 5: mod_base = OTHER; note = 2'-O-methyladenosine-3'-phosphate
  modified_base 6: mod_base = OTHER; note = 2'-O-methylguanosine-3'-phosphate
  modified_base 7: mod_base = OTHER; note = 2'-O-methyladenosine-3'-phosphate
  modified_base 8: mod_base = OTHER; note = 2'-O-methylguanosine-3'-phosphate
  modified_base 9: mod_base = OTHER; note = 2'-O-methylcytidine-3'-phosphate
  modified_base 11: mod_base = OTHER; note = 2'-O-methyladenosine-3'-phosphate
  modified_base 12: mod_base = OTHER; note = 2'-O-methylguanosine-3'-phosphate
  modified_base 13: mod_base = OTHER; note = 2'-O-methyladenosine-3'-phosphate
  modified_base 15: mod_base = OTHER; note = 2'-O-methylcytidine-3'-phosphate
  modified_base 16: mod_base = OTHER; note = 2'-O-methyladenosine-3'-phosphate
  modified_base 17: mod_base = OTHER; note = 2'-O-methylcytidine-3'-phosphate
  modified_base 18: mod_base = OTHER; note = 2'-O-methyluridine-3'-phosphate
  modified_base 19: mod_base = OTHER; note = 2'-O-methylguanosine-3'-phosphate
  modified_base 20: mod_base = OTHER; note = 2'-O-methyluridine-3'-phosphate
  modified_base 21: mod_base = OTHER; note = 2'-O-methyluridine-3'-phosphorothioate
  modified_base 22: mod_base = OTHER; note = 2'-O-methyluridine-3'-phosphorothioate
  modified_base 23: mod_base = OTHER; note = 2'-O-methyluridine
  misc_feature 1: note = RNA
  misc_feature 3..9: note = RNA
  misc_feature 11..13: note = RNA
  misc_feature 15..23: note = RNA
  misc_feature 2: note = DNA
  misc_feature 10: note = DNA
  misc_feature 14: note = DNA
ttatagagcaagaacactgtttt

SEQ ID NO: 46 - DNA, 23 bp, synthetic construct
  source 1..23: mol_type = other DNA
  modified_base 1: mod_base = OTHER; note = 2'-O-methyluridine-3'-phosphorothioate
  modified_base 2: mod_base = OTHER; note = 2'-deoxythymidine-3'-phosphorothioate
  modified_base 3: mod_base = OTHER; note = 2'-O-methyladenosine-3'-phosphate
  modified_base 4: mod_base = OTHER; note = 2'-O-methyluridine-3'-phosphate
  modified_base 5: mod_base = OTHER; note = 2'-O-methyladenosine-3'-phosphate
  modified_base 6: mod_base = OTHER; note = 2'-O-methylguanosine-3'-phosphate
  modified_base 7: mod_base = OTHER; note = 2'-O-methyladenosine-3'-phosphate
  modified_base 8: mod_base = OTHER; note = 2'-O-methylguanosine-3'-phosphate
  modified_base 9: mod_base = OTHER; note = 2'-O-methylcytidine-3'-phosphate
  modified_base 11: mod_base = OTHER; note = 2'-O-methyladenosine-3'-phosphate
  modified_base 12: mod_base = OTHER; note = 2'-O-methylguanosine-3'-phosphate
  modified_base 13: mod_base = OTHER; note = 2'-O-methyladenosine-3'-phosphate
  modified_base 15: mod_base = OTHER; note = 2'-O-methylcytidine-3'-phosphate
  modified_base 16: mod_base = OTHER; note = 2'-O-methyladenosine-3'-phosphate
  modified_base 17: mod_base = OTHER; note = 2'-O-methylcytidine-3'-phosphate
  modified_base 18: mod_base = OTHER; note = 2'-O-methyluridine-3'-phosphate
  modified_base 19: mod_base = OTHER; note = 2'-O-methylguanosine-3'-phosphate
  modified_base 20: mod_base = OTHER; note = 2'-O-methyluridine-3'-phosphate
  modified_base 21: mod_base = OTHER; note = 2'-O-methyluridine-3'-phosphorothioate
  modified_base 22: mod_base = OTHER; note = 2'-O-methyluridine-3'-phosphorothioate
  modified_base 23: mod_base = OTHER; note = 2'-O-methyluridine
  misc_feature 1: note = RNA
  misc_feature 3..9: note = RNA
  misc_feature 11..13: note = RNA
  misc_feature 15..23: note = RNA
  misc_feature 2: note = DNA
  misc_feature 10: note = DNA
  misc_feature 14: note = DNA
ttatagagcaagaacactgtttt

SEQ ID NO: 47 - RNA, 23 nt, synthetic construct
  source 1..23: mol_type = other RNA
  modified_base 1: mod_base = OTHER; note = 2'-O-methyluridine-3'-phosphorothioate
  modified_base 2: mod_base = OTHER; note = 2'-deoxy-2'-fluorouridine-3'-phosphorothioate
  modified_base 3: mod_base = OTHER; note = 2'-O-methyladenosine-3'-phosphate
  modified_base 4: mod_base = OTHER; note = 2'-deoxy-2'-fluorouridine-3'-phosphate
  modified_base 5: mod_base = OTHER; note = 2'-O-methyladenosine-3'-phosphate
  modified_base 6: mod_base = OTHER; note = 2'-deoxy-2'-fluoroguanosine-3'-phosphate
  modified_base 7: mod_base = OTHER; note = 2'-O-methyladenosine-3'-phosphate
  modified_base 8: mod_base = OTHER; note = 2'-deoxy-2'-fluoroguanosine-3'-phosphate
  modified_base 9: mod_base = OTHER; note = 2'-O-methylcytidine-3'-phosphate
  modified_base 10: mod_base = OTHER; note = 2'-deoxy-2'-fluoroadenosine-3'-phosphate
  modified_base 11: mod_base = OTHER; note = 2'-O-methyladenosine-3'-phosphate
  modified_base 12: mod_base = OTHER; note = 2'-O-methylguanosine-3'-phosphate
  modified_base 13: mod_base = OTHER; note = 2'-O-methyladenosine-3'-phosphate
  modified_base 14: mod_base = OTHER; note = 2'-deoxy-2'-fluoroadenosine-3'-phosphate
  modified_base 15: mod_base = OTHER; note = 2'-O-methylcytidine-3'-phosphate
  modified_base 16: mod_base = OTHER; note = 2'-deoxy-2'-fluoroadenosine-3'-phosphate
  modified_base 17: mod_base = OTHER; note = 2'-O-methylcytidine-3'-phosphate
  modified_base 18: mod_base = OTHER; note = 2'-deoxy-2'-fluorouridine-3'-phosphate
  modified_base 19: mod_base = OTHER; note = 2'-O-methylguanosine-3'-phosphate
  modified_base 20: mod_base = OTHER; note = 2'-deoxy-2'-fluorouridine-3'-phosphate
  modified_base 21: mod_base = OTHER; note = 2'-O-methyluridine-3'-phosphorothioate
  modified_base 22: mod_base = OTHER; note = 2'-O-methyluridine-3'-phosphorothioate
  modified_base 23: mod_base = OTHER; note = 2'-O-methyluridine
ttatagagcaagaacactgtttt

SEQ ID NO: 48 - RNA, 23 nt, synthetic construct
  source 1..23: mol_type = other RNA
  modified_base 1: mod_base = OTHER; note = 2'-O-methyluridine-3'-phosphorothioate
  modified_base 2: mod_base = OTHER; note = 2'-deoxy-2'-fluorouridine-3'-phosphorothioate
  modified_base 3: mod_base = OTHER; note = 2'-O-methyladenosine-3'-phosphate
  modified_base 4: mod_base = OTHER; note = 2'-deoxy-2'-fluorouridine-3'-phosphate
  modified_base 5: mod_base = OTHER; note = 2'-O-methyladenosine-3'-phosphate
  modified_base 6: mod_base = OTHER; note = 2'-deoxy-2'-fluoroguanosine-3'-phosphate
  modified_base 7: mod_base = OTHER; note = 2'-O-methyladenosine-3'-phosphate
  modified_base 8: mod_base = OTHER; note = 2'-deoxy-2'-fluoroguanosine-3'-phosphate
  modified_base 9: mod_base = OTHER; note = 2'-O-methylcytidine-3'-phosphate
  modified_base 10: mod_base = OTHER; note = 2'-deoxy-2'-fluoroadenosine-3'-phosphate
  modified_base 11: mod_base = OTHER; note = 2'-O-methyladenosine-3'-phosphate
  modified_base 12: mod_base = OTHER; note = 2'-O-methylguanosine-3'-phosphate
  modified_base 13: mod_base = OTHER; note = 2'-O-methyladenosine-3'-phosphate
  modified_base 14: mod_base = OTHER; note = 2'-deoxy-2'-fluoroadenosine-3'-phosphate
  modified_base 15: mod_base = OTHER; note = 2'-O-methylcytidine-3'-phosphate
  modified_base 16: mod_base = OTHER; note = 2'-deoxy-2'-fluoroadenosine-3'-phosphate
  modified_base 17: mod_base = OTHER; note = 2'-O-methylcytidine-3'-phosphate
  modified_base 18: mod_base = OTHER; note = 2'-deoxy-2'-fluorouridine-3'-phosphate
  modified_base 19: mod_base = OTHER; note = 2'-O-methylguanosine-3'-phosphate
  modified_base 20: mod_base = OTHER; note = 2'-deoxy-2'-fluorouridine-3'-phosphate
  modified_base 21: mod_base = OTHER; note = 2'-O-methyluridine-3'-phosphorothioate
  modified_base 22: mod_base = OTHER; note = 2'-O-methyluridine-3'-phosphorothioate
  modified_base 23: mod_base = OTHER; note = 2'-O-methyluridine
ttatagagcaagaacactgtttt

SEQ ID NO: 49 - RNA, 23 nt, synthetic construct
  source 1..23: mol_type = other RNA
  modified_base 1: mod_base = OTHER; note = 2'-O-methyluridine-3'-phosphorothioate
  modified_base 2: mod_base = OTHER; note = 2'-deoxy-2'-fluorouridine-3'-phosphorothioate
  modified_base 3: mod_base = OTHER; note = 2'-O-methyladenosine-3'-phosphate
  modified_base 4: mod_base = OTHER; note = 2'-deoxy-2'-fluorouridine-3'-phosphate
  modified_base 5: mod_base = OTHER; note = 2'-O-methyladenosine-3'-phosphate
  modified_base 6: mod_base = OTHER; note = 2'-deoxy-2'-fluoroguanosine-3'-phosphate
  modified_base 7: mod_base = OTHER; note = 2'-O-methyladenosine-3'-phosphate
  modified_base 8: mod_base = OTHER; note = 2'-deoxy-2'-fluoroguanosine-3'-phosphate
  modified_base 9: mod_base = OTHER; note = 2'-O-methylcytidine-3'-phosphate
  modified_base 10: mod_base = OTHER; note = 2'-deoxy-2'-fluoroadenosine-3'-phosphate
  modified_base 11: mod_base = OTHER; note = 2'-O-methyladenosine-3'-phosphate
  modified_base 12: mod_base = OTHER; note = 2'-O-methylguanosine-3'-phosphate
  modified_base 13: mod_base = OTHER; note = 2'-O-methyladenosine-3'-phosphate
  modified_base 14: mod_base = OTHER; note = 2'-deoxy-2'-fluoroadenosine-3'-phosphate
  modified_base 15: mod_base = OTHER; note = 2'-O-methylcytidine-3'-phosphate
  modified_base 16: mod_base = OTHER; note = 2'-deoxy-2'-fluoroadenosine-3'-phosphate
  modified_base 17: mod_base = OTHER; note = 2'-O-methylcytidine-3'-phosphate
  modified_base 18: mod_base = OTHER; note = 2'-deoxy-2'-fluorouridine-3'-phosphate
  modified_base 19: mod_base = OTHER; note = 2'-O-methylguanosine-3'-phosphate
  modified_base 20: mod_base = OTHER; note = 2'-deoxy-2'-fluorouridine-3'-phosphate
  modified_base 21: mod_base = OTHER; note = 2'-O-methyluridine-3'-phosphorothioate
  modified_base 22: mod_base = OTHER; note = 2'-O-methyluridine-3'-phosphorothioate
  modified_base 23: mod_base = OTHER; note = 2'-O-methyluridine
ttatagagcaagaacactgtttt

SEQ ID NO: 50 - RNA, 23 nt, synthetic construct
  source 1..23: mol_type = other RNA
  modified_base 1: mod_base = OTHER; note = 2'-O-methyluridine-3'-phosphorothioate
  modified_base 2: mod_base = OTHER; note = 2'-deoxy-2'-fluorouridine-3'-phosphorothioate
  modified_base 3: mod_base = OTHER; note = 2'-O-methyladenosine-3'-phosphate
  modified_base 4: mod_base = OTHER; note = 2'-deoxy-2'-fluorouridine-3'-phosphate
  modified_base 5: mod_base = OTHER; note = 2'-O-methyladenosine-3'-phosphate
  modified_base 6: mod_base = OTHER; note = 2'-deoxy-2'-fluoroguanosine-3'-phosphate
  modified_base 7: mod_base = OTHER; note = 2'-O-methyladenosine-3'-phosphate
  modified_base 8: mod_base = OTHER; note = 2'-deoxy-2'-fluoroguanosine-3'-phosphate
  modified_base 9: mod_base = OTHER; note = 2'-O-methylcytidine-3'-phosphate
  modified_base 10: mod_base = OTHER; note = 2'-deoxy-2'-fluoroadenosine-3'-phosphate
  modified_base 11: mod_base = OTHER; note = 2'-O-methyladenosine-3'-phosphate
  modified_base 12: mod_base = OTHER; note = 2'-O-methylguanosine-3'-phosphate
  modified_base 13: mod_base = OTHER; note = 2'-O-methyladenosine-3'-phosphate
  modified_base 14: mod_base = OTHER; note = 2'-deoxy-2'-fluoroadenosine-3'-phosphate
  modified_base 15: mod_base = OTHER; note = 2'-O-methylcytidine-3'-phosphate
  modified_base 16: mod_base = OTHER; note = 2'-deoxy-2'-fluoroadenosine-3'-phosphate
  modified_base 17: mod_base = OTHER; note = 2'-O-methylcytidine-3'-phosphate
  modified_base 18: mod_base = OTHER; note = 2'-deoxy-2'-fluorouridine-3'-phosphate
  modified_base 19: mod_base = OTHER; note = 2'-O-methylguanosine-3'-phosphate
  modified_base 20: mod_base = OTHER; note = 2'-deoxy-2'-fluorouridine-3'-phosphate
  modified_base 21: mod_base = OTHER; note = 2'-O-methyluridine-3'-phosphorothioate
  modified_base 22: mod_base = OTHER; note = 2'-O-methyluridine-3'-phosphorothioate
  modified_base 23: mod_base = OTHER; note = 2'-O-methyluridine
ttatagagcaagaacactgtttt

SEQ ID NO: 51 - RNA, 23 nt, synthetic construct
  source 1..23: mol_type = other RNA
  modified_base 1: mod_base = OTHER; note = 2'-O-methyluridine-3'-phosphorothioate
  modified_base 2: mod_base = OTHER; note = 2'-deoxy-2'-fluorouridine-3'-phosphorothioate
  modified_base 3: mod_base = OTHER; note = 2'-O-methyladenosine-3'-phosphate
  modified_base 4: mod_base = OTHER; note = 2'-deoxy-2'-fluorouridine-3'-phosphate
  modified_base 5: mod_base = OTHER; note = 2'-O-methyladenosine-3'-phosphate
  modified_base 6: mod_base = OTHER; note = 2'-deoxy-2'-fluoroguanosine-3'-phosphate
  modified_base 7: mod_base = OTHER; note = 2'-O-methyladenosine-3'-phosphate
  modified_base 8: mod_base = OTHER; note = 2'-deoxy-2'-fluoroguanosine-3'-phosphate
  modified_base 9: mod_base = OTHER; note = 2'-O-methylcytidine-3'-phosphate
  modified_base 10: mod_base = OTHER; note = 2'-deoxy-2'-fluoroadenosine-3'-phosphate
  modified_base 11: mod_base = OTHER; note = 2'-O-methyladenosine-3'-phosphate
  modified_base 12: mod_base = OTHER; note = 2'-O-methylguanosine-3'-phosphate
  modified_base 13: mod_base = OTHER; note = 2'-O-methyladenosine-3'-phosphate
  modified_base 14: mod_base = OTHER; note = 2'-deoxy-2'-fluoroadenosine-3'-phosphate
  modified_base 15: mod_base = OTHER; note = 2'-O-methylcytidine-3'-phosphate
  modified_base 16: mod_base = OTHER; note = 2'-deoxy-2'-fluoroadenosine-3'-phosphate
  modified_base 17: mod_base = OTHER; note = 2'-O-methylcytidine-3'-phosphate
  modified_base 18: mod_base = OTHER; note = 2'-deoxy-2'-fluorouridine-3'-phosphate
  modified_base 19: mod_base = OTHER; note = 2'-O-methylguanosine-3'-phosphate
  modified_base 20: mod_base = OTHER; note = 2'-deoxy-2'-fluorouridine-3'-phosphate
  modified_base 21: mod_base = OTHER; note = 2'-O-methyluridine-3'-phosphorothioate
  modified_base 22: mod_base = OTHER; note = 2'-O-methyluridine-3'-phosphorothioate
  modified_base 23: mod_base = OTHER; note = 2'-O-methyluridine
ttatagagcaagaacactgtttt

SEQ ID NO: 52 - DNA, 23 bp, synthetic construct
  source 1..23: mol_type = other DNA
  modified_base 1: mod_base = OTHER; note = 2'-O-methyluridine-3'-phosphorothioate
  modified_base 2: mod_base = OTHER; note = 2'-deoxythymidine-3'-phosphorothioate
  modified_base 3: mod_base = OTHER; note = 2'-O-methyladenosine-3'-phosphate
  modified_base 4: mod_base = OTHER; note = 2'-O-methyluridine-3'-phosphate
  modified_base 5: mod_base = OTHER; note = 2'-O-methyladenosine-3'-phosphate
  modified_base 6: mod_base = OTHER; note = 2'-O-methylguanosine-3'-phosphate
  modified_base 7: mod_base = OTHER; note = 2'-O-methyladenosine-3'-phosphate
  modified_base 8: mod_base = OTHER; note = 2'-O-methylguanosine-3'-phosphate
  modified_base 9: mod_base = OTHER; note = 2'-O-methylcytidine-3'-phosphate
  modified_base 11: mod_base = OTHER; note = 2'-O-methyladenosine-3'-phosphate
  modified_base 12: mod_base = OTHER; note = 2'-O-methylguanosine-3'-phosphate
  modified_base 13: mod_base = OTHER; note = 2'-O-methyladenosine-3'-phosphate
  modified_base 15: mod_base = OTHER; note = 2'-O-methylcytidine-3'-phosphate
  modified_base 16: mod_base = OTHER; note = 2'-O-methyladenosine-3'-phosphate
  modified_base 17: mod_base = OTHER; note = 2'-O-methylcytidine-3'-phosphate
  modified_base 18: mod_base = OTHER; note = 2'-O-methyluridine-3'-phosphate
  modified_base 19: mod_base = OTHER; note = 2'-O-methylguanosine-3'-phosphate
  modified_base 20: mod_base = OTHER; note = 2'-O-methyluridine-3'-phosphate
  modified_base 21: mod_base = OTHER; note = 2'-O-methyluridine-3'-phosphorothioate
  modified_base 22: mod_base = OTHER; note = 2'-O-methyluridine-3'-phosphorothioate
  modified_base 23: mod_base = OTHER; note = 2'-O-methyluridine
  misc_feature 1: note = RNA
  misc_feature 3..9: note = RNA
  misc_feature 11..13: note = RNA
  misc_feature 15..23: note = RNA
  misc_feature 2: note = DNA
  misc_feature 10: note = DNA
  misc_feature 14: note = DNA
ttatagagcaagaacactgtttt

SEQ ID NO: 53 - DNA, 23 bp, synthetic construct
  source 1..23: mol_type = other DNA
  modified_base 1: mod_base = OTHER; note = 2'-O-methyluridine-3'-phosphorothioate
  modified_base 2: mod_base = OTHER; note = 2'-deoxythymidine-3'-phosphorothioate
  modified_base 3: mod_base = OTHER; note = 2'-O-methyladenosine-3'-phosphate
  modified_base 4: mod_base = OTHER; note = 2'-O-methyluridine-3'-phosphate
  modified_base 5: mod_base = OTHER; note = 2'-O-methyladenosine-3'-phosphate
  modified_base 6: mod_base = OTHER; note = 2'-O-methylguanosine-3'-phosphate
  modified_base 7: mod_base = OTHER; note = 2'-O-methyladenosine-3'-phosphate
  modified_base 8: mod_base = OTHER; note = 2'-O-methylguanosine-3'-phosphate
  modified_base 9: mod_base = OTHER; note = 2'-O-methylcytidine-3'-phosphate
  modified_base 11: mod_base = OTHER; note = 2'-O-methyladenosine-3'-phosphate
  modified_base 12: mod_base = OTHER; note = 2'-O-methylguanosine-3'-phosphate
  modified_base 13: mod_base = OTHER; note = 2'-O-methyladenosine-3'-phosphate
  modified_base 15: mod_base = OTHER; note = 2'-O-methylcytidine-3'-phosphate
  modified_base 16: mod_base = OTHER; note = 2'-O-methyladenosine-3'-phosphate
  modified_base 17: mod_base = OTHER; note = 2'-O-methylcytidine-3'-phosphate
  modified_base 18: mod_base = OTHER; note = 2'-O-methyluridine-3'-phosphate
  modified_base 19: mod_base = OTHER; note = 2'-O-methylguanosine-3'-phosphate
  modified_base 20: mod_base = OTHER; note = 2'-O-methyluridine-3'-phosphate
  modified_base 21: mod_base = OTHER; note = 2'-O-methyluridine-3'-phosphorothioate
  modified_base 22: mod_base = OTHER; note = 2'-O-methyluridine-3'-phosphorothioate
  modified_base 23: mod_base = OTHER; note = 2'-O-methyluridine
  misc_feature 1: note = RNA
  misc_feature 3..9: note = RNA
  misc_feature 11..13: note = RNA
  misc_feature 15..23: note = RNA
  misc_feature 2: note = DNA
  misc_feature 10: note = DNA
  misc_feature 14: note = DNA
ttatagagcaagaacactgtttt

SEQ ID NO: 54 - RNA, 23 nt, synthetic construct
  source 1..23: mol_type = other RNA
  modified_base 1: mod_base = OTHER; note = 2'-O-methyladenosine-3'-phosphorothioate
  modified_base 2: mod_base = OTHER; note = 2'-deoxy-2'-fluoroadenosine-3'-phosphorothioate
  modified_base 3: mod_base = OTHER; note = 2'-O-methyladenosine-3'-phosphate
  modified_base 4: mod_base = OTHER; note = 2'-deoxy-2'-fluoroadenosine-3'-phosphate
  modified_base 5: mod_base = OTHER; note = 2'-O-methyladenosine-3'-phosphate
  modified_base 6: mod_base = OTHER; note = 2'-deoxy-2'-fluoroguanosine-3'-phosphate
  modified_base 7: mod_base = OTHER; note = 2'-O-methyladenosine-3'-phosphate
  modified_base 8: mod_base = OTHER; note = 2'-deoxy-2'-fluorocytidine-3'-phosphate
  modified_base 9: mod_base = OTHER; note = 2'-O-methyluridine-3'-phosphate
  modified_base 10: mod_base = OTHER; note = 2'-deoxy-2'-fluoroguanosine-3'-phosphate
  modified_base 11: mod_base = OTHER; note = 2'-O-methyladenosine-3'-phosphate
  modified_base 12: mod_base = OTHER; note = 2'-O-methyluridine-3'-phosphate
  modified_base 13: mod_base = OTHER; note = 2'-O-methylcytidine-3'-phosphate
  modified_base 14: mod_base = OTHER; note = 2'-deoxy-2'-fluoroadenosine-3'-phosphate
  modified_base 15: mod_base = OTHER; note = 2'-O-methyladenosine-3'-phosphate
  modified_base 16: mod_base = OTHER; note = 2'-deoxy-2'-fluoroadenosine-3'-phosphate
  modified_base 17: mod_base = OTHER; note = 2'-O-methyluridine-3'-phosphate
  modified_base 18: mod_base = OTHER; note = 2'-deoxy-2'-fluoroadenosine-3'-phosphate
  modified_base 19: mod_base = OTHER; note = 2'-O-methyluridine-3'-phosphate
  modified_base 20: mod_base = OTHER; note = 2'-deoxy-2'-fluoroguanosine-3'-phosphate
  modified_base 21: mod_base = OTHER; note = 2'-O-methyluridine-3'-phosphorothioate
  modified_base 22: mod_base = OTHER; note = 2'-O-methyluridine-3'-phosphorothioate
  modified_base 23: mod_base = OTHER; note = 2'-O-methylguanosine
aaaaagactgatcaaatatgttg

SEQ ID NO: 55 - RNA, 23 nt, synthetic construct
  source 1..23: mol_type = other RNA
  modified_base 1: mod_base = OTHER; note = 2'-O-methyladenosine-3'-phosphorothioate
  modified_base 2: mod_base = OTHER; note = 2'-deoxy-2'-fluoroadenosine-3'-phosphorothioate
  modified_base 3: mod_base = OTHER; note = 2'-O-methyladenosine-3'-phosphate
  modified_base 4: mod_base = OTHER; note = 2'-deoxy-2'-fluoroadenosine-3'-phosphate
  modified_base 5: mod_base = OTHER; note = 2'-O-methyladenosine-3'-phosphate
  modified_base 6: mod_base = OTHER; note = 2'-deoxy-2'-fluoroguanosine-3'-phosphate
  modified_base 7: mod_base = OTHER; note = 2'-O-methyladenosine-3'-phosphate
  modified_base 8: mod_base = OTHER; note = 2'-deoxy-2'-fluorocytidine-3'-phosphate
  modified_base 9: mod_base = OTHER; note = 2'-O-methyluridine-3'-phosphate
  modified_base 10: mod_base = OTHER; note = 2'-deoxy-2'-fluoroguanosine-3'-phosphate
  modified_base 11: mod_base = OTHER; note = 2'-O-methyladenosine-3'-phosphate
  modified_base 12: mod_base = OTHER; note = 2'-O-methyluridine-3'-phosphate
  modified_base 13: mod_base = OTHER; note = 2'-O-methylcytidine-3'-phosphate
  modified_base 14: mod_base = OTHER; note = 2'-deoxy-2'-fluoroadenosine-3'-phosphate
  modified_base 15: mod_base = OTHER; note = 2'-O-methyladenosine-3'-phosphate
  modified_base 16: mod_base = OTHER; note = 2'-deoxy-2'-fluoroadenosine-3'-phosphate
  modified_base 17: mod_base = OTHER; note = 2'-O-methyluridine-3'-phosphate
  modified_base 18: mod_base = OTHER; note = 2'-deoxy-2'-fluoroadenosine-3'-phosphate
  modified_base 19: mod_base = OTHER; note = 2'-O-methyluridine-3'-phosphate
  modified_base 20: mod_base = OTHER; note = 2'-deoxy-2'-fluoroguanosine-3'-phosphate
  modified_base 21: mod_base = OTHER; note = 2'-O-methyluridine-3'-phosphorothioate
  modified_base 22: mod_base = OTHER; note = 2'-O-methyluridine-3'-phosphorothioate
  modified_base 23: mod_base = OTHER; note = 2'-O-methylguanosine
aaaaagactgatcaaatatgttg

SEQ ID NO: 56 - RNA, 23 nt, synthetic construct
  source 1..23: mol_type = other RNA
  modified_base 1: mod_base = OTHER; note = 2'-O-methyladenosine-3'-phosphorothioate
  modified_base 2: mod_base = OTHER; note = 2'-deoxy-2'-fluoroadenosine-3'-phosphorothioate
  modified_base 3: mod_base = OTHER; note = 2'-O-methyladenosine-3'-phosphate
  modified_base 4: mod_base = OTHER; note = 2'-deoxy-2'-fluoroadenosine-3'-phosphate
  modified_base 5: mod_base = OTHER; note = 2'-O-methyladenosine-3'-phosphate
  modified_base 6: mod_base = OTHER; note = 2'-deoxy-2'-fluoroguanosine-3'-phosphate
  modified_base 7: mod_base = OTHER; note = 2'-O-methyladenosine-3'-phosphate
  modified_base 8: mod_base = OTHER; note = 2'-deoxy-2'-fluorocytidine-3'-phosphate
  modified_base 9: mod_base = OTHER; note = 2'-O-methyluridine-3'-phosphate
  modified_base 10: mod_base = OTHER; note = 2'-deoxy-2'-fluoroguanosine-3'-phosphate
  modified_base 11: mod_base = OTHER; note = 2'-O-methyladenosine-3'-phosphate
  modified_base 12: mod_base = OTHER; note = 2'-O-methyluridine-3'-phosphate
  modified_base 13: mod_base = OTHER; note = 2'-O-methylcytidine-3'-phosphate
  modified_base 14: mod_base = OTHER; note = 2'-deoxy-2'-fluoroadenosine-3'-phosphate
  modified_base 15: mod_base = OTHER; note = 2'-O-methyladenosine-3'-phosphate
  modified_base 16: mod_base = OTHER; note = 2'-deoxy-2'-fluoroadenosine-3'-phosphate
  modified_base 17: mod_base = OTHER; note = 2'-O-methyluridine-3'-phosphate
  modified_base 18: mod_base = OTHER; note = 2'-deoxy-2'-fluoroadenosine-3'-phosphate
  modified_base 19: mod_base = OTHER; note = 2'-O-methyluridine-3'-phosphate
  modified_base 20: mod_base = OTHER; note = 2'-deoxy-2'-fluoroguanosine-3'-phosphate
  modified_base 21: mod_base = OTHER; note = 2'-O-methyluridine-3'-phosphorothioate
  modified_base 22: mod_base = OTHER; note = 2'-O-methyluridine-3'-phosphorothioate
  modified_base 23: mod_base = OTHER; note = 2'-O-methylguanosine
aaaaagactgatcaaatatgttg

SEQ ID NO: 57 - RNA, 23 nt, synthetic construct
  source 1..23: mol_type = other RNA
  modified_base 1: mod_base = OTHER; note = 2'-O-methyladenosine-3'-phosphorothioate
  modified_base 2: mod_base = OTHER; note = 2'-deoxy-2'-fluoroadenosine-3'-phosphorothioate
  modified_base 3: mod_base = OTHER; note = 2'-O-methyladenosine-3'-phosphate
  modified_base 4: mod_base = OTHER; note = 2'-deoxy-2'-fluoroadenosine-3'-phosphate
  modified_base 5: mod_base = OTHER; note = 2'-O-methyladenosine-3'-phosphate
  modified_base 6: mod_base = OTHER; note = 2'-deoxy-2'-fluoroguanosine-3'-phosphate
  modified_base 7: mod_base = OTHER; note = 2'-O-methyladenosine-3'-phosphate
  modified_base 8: mod_base = OTHER; note = 2'-deoxy-2'-fluorocytidine-3'-phosphate
  modified_base 9: mod_base = OTHER; note = 2'-O-methyluridine-3'-phosphate
  modified_base 10: mod_base = OTHER; note = 2'-deoxy-2'-fluoroguanosine-3'-phosphate
  modified_base 11: mod_base = OTHER; note = 2'-O-methyladenosine-3'-phosphate
  modified_base 12: mod_base = OTHER; note = 2'-O-methyluridine-3'-phosphate
  modified_base 13: mod_base = OTHER; note = 2'-O-methylcytidine-3'-phosphate
  modified_base 14: mod_base = OTHER; note = 2'-deoxy-2'-fluoroadenosine-3'-phosphate
  modified_base 15: mod_base = OTHER; note = 2'-O-methyladenosine-3'-phosphate
  modified_base 16: mod_base = OTHER; note = 2'-deoxy-2'-fluoroadenosine-3'-phosphate
  modified_base 17: mod_base = OTHER; note = 2'-O-methyluridine-3'-phosphate
  modified_base 18: mod_base = OTHER; note = 2'-deoxy-2'-fluoroadenosine-3'-phosphate
  modified_base 19: mod_base = OTHER; note = 2'-O-methyluridine-3'-phosphate
  modified_base 20: mod_base = OTHER; note = 2'-deoxy-2'-fluoroguanosine-3'-phosphate
  modified_base 21: mod_base = OTHER; note = 2'-O-methyluridine-3'-phosphorothioate
  modified_base 22: mod_base = OTHER; note = 2'-O-methyluridine-3'-phosphorothioate
  modified_base 23: mod_base = OTHER; note = 2'-O-methylguanosine
aaaaagactgatcaaatatgttg

SEQ ID NO: 58 - RNA, 23 nt, synthetic construct
  source 1..23: mol_type = other RNA
  modified_base 1: mod_base = OTHER; note = 2'-O-methyladenosine-3'-phosphorothioate
  modified_base 2: mod_base = OTHER; note = 2'-deoxy-2'-fluoroadenosine-3'-phosphorothioate
  modified_base 3: mod_base = OTHER; note = 2'-O-methyladenosine-3'-phosphate
  modified_base 4: mod_base = OTHER; note = 2'-deoxy-2'-fluoroadenosine-3'-phosphate
  modified_base 5: mod_base = OTHER; note = 2'-O-methyladenosine-3'-phosphate
  modified_base 6: mod_base = OTHER; note = 2'-deoxy-2'-fluoroguanosine-3'-phosphate
  modified_base 7: mod_base = OTHER; note = 2'-O-methyladenosine-3'-phosphate
  modified_base 8: mod_base = OTHER; note = 2'-deoxy-2'-fluorocytidine-3'-phosphate
  modified_base 9: mod_base = OTHER; note = 2'-O-methyluridine-3'-phosphate
  modified_base 10: mod_base = OTHER; note = 2'-deoxy-2'-fluoroguanosine-3'-phosphate
  modified_base 11: mod_base = OTHER; note = 2'-O-methyladenosine-3'-phosphate
  modified_base 12: mod_base = OTHER; note = 2'-O-methyluridine-3'-phosphate
  modified_base 13: mod_base = OTHER; note = 2'-O-methylcytidine-3'-phosphate
  modified_base 14: mod_base = OTHER; note = 2'-deoxy-2'-fluoroadenosine-3'-phosphate
  modified_base 15: mod_base = OTHER; note = 2'-O-methyladenosine-3'-phosphate
  modified_base 16: mod_base = OTHER; note = 2'-deoxy-2'-fluoroadenosine-3'-phosphate
  modified_base 17: mod_base = OTHER; note = 2'-O-methyluridine-3'-phosphate
  modified_base 18: mod_base = OTHER; note = 2'-deoxy-2'-fluoroadenosine-3'-phosphate
  modified_base 19: mod_base = OTHER; note = 2'-O-methyluridine-3'-phosphate
  modified_base 20: mod_base = OTHER; note = 2'-deoxy-2'-fluoroguanosine-3'-phosphate
  modified_base 21: mod_base = OTHER; note = 2'-O-methyluridine-3'-phosphorothioate
  modified_base 22: mod_base = OTHER; note = 2'-O-methyluridine-3'-phosphorothioate
  modified_base 23: mod_base = OTHER; note = 2'-O-methylguanosine
aaaaagactgatcaaatatgttg

SEQ ID NO: 59 - RNA, 23 nt, synthetic construct
  source 1..23: mol_type = other RNA
  modified_base 1: mod_base = OTHER; note = 2'-O-methyladenosine-3'-phosphorothioate
  modified_base 2: mod_base = OTHER; note = 2'-deoxy-2'-fluoroadenosine-3'-phosphorothioate
  modified_base 3: mod_base = OTHER; note = 2'-O-methyladenosine-3'-phosphate
  modified_base 4: mod_base = OTHER; note = 2'-deoxy-2'-fluoroadenosine-3'-phosphate
  modified_base 5: mod_base = OTHER; note = 2'-O-methyladenosine-3'-phosphate
  modified_base 6: mod_base = OTHER; note = 2'-deoxy-2'-fluoroguanosine-3'-phosphate
  modified_base 7: mod_base = OTHER; note = 2'-O-methyladenosine-3'-phosphate
  modified_base 8: mod_base = OTHER; note = 2'-deoxy-2'-fluorocytidine-3'-phosphate
  modified_base 9: mod_base = OTHER; note = 2'-O-methyluridine-3'-phosphate
  modified_base 10: mod_base = OTHER; note = 2'-deoxy-2'-fluoroguanosine-3'-phosphate
  modified_base 11: mod_base = OTHER; note = 2'-O-methyladenosine-3'-phosphate
  modified_base 12: mod_base = OTHER; note = 2'-O-methyluridine-3'-phosphate
  modified_base 13: mod_base = OTHER; note = 2'-O-methylcytidine-3'-phosphate
  modified_base 14: mod_base = OTHER; note = 2'-deoxy-2'-fluoroadenosine-3'-phosphate
  modified_base 15: mod_base = OTHER; note = 2'-O-methyladenosine-3'-phosphate
  modified_base 16: mod_base = OTHER; note = 2'-deoxy-2'-fluoroadenosine-3'-phosphate
  modified_base 17: mod_base = OTHER; note = 2'-O-methyluridine-3'-phosphate
  modified_base 18: mod_base = OTHER; note = 2'-deoxy-2'-fluoroadenosine-3'-phosphate
  modified_base 19: mod_base = OTHER; note = 2'-O-methyluridine-3'-phosphate
  modified_base 20: mod_base = OTHER; note = 2'-deoxy-2'-fluoroguanosine-3'-phosphate
  modified_base 21: mod_base = OTHER; note = 2'-O-methyluridine-3'-phosphorothioate
  modified_base 22: mod_base = OTHER; note = 2'-O-methyluridine-3'-phosphorothioate
  modified_base 23: mod_base = OTHER; note = 2'-O-methylguanosine
aaaaagactgatcaaatatgttg

SEQ ID NO: 60 - RNA, 23 nt, synthetic construct
  source 1..23: mol_type = other RNA
  modified_base 1: mod_base = OTHER; note = 2'-O-methyladenosine-3'-phosphorothioate
  modified_base 2: mod_base = OTHER; note = 2'-deoxy-2'-fluoroguanosine-3'-phosphorothioate
  modified_base 3: mod_base = OTHER; note = 2'-O-methyladenosine-3'-phosphate
  modified_base 4: mod_base = OTHER; note = 2'-deoxy-2'-fluoroadenosine-3'-phosphate
  modified_base 5: mod_base = OTHER; note = 2'-O-methyluridine-3'-phosphate
  modified_base 6: mod_base = OTHER; note = 2'-deoxy-2'-fluoroadenosine-3'-phosphate
  modified_base 7: mod_base = OTHER; note = 2'-O-methylcytidine-3'-phosphate
  modified_base 8: mod_base = OTHER; note = 2'-deoxy-2'-fluorouridine-3'-phosphate
  modified_base 9: mod_base = OTHER; note = 2'-O-methylguanosine-3'-phosphate
  modified_base 10: mod_base = OTHER; note = 2'-deoxy-2'-fluorouridine-3'-phosphate
  modified_base 11: mod_base = OTHER; note = 2'-O-methylcytidine-3'-phosphate
  modified_base 12: mod_base = OTHER; note = 2'-O-methylcytidine-3'-phosphate
  modified_base 13: mod_base = OTHER; note = 2'-O-methylcytidine-3'-phosphate
  modified_base 14: mod_base = OTHER; note = 2'-deoxy-2'-fluorouridine-3'-phosphate
  modified_base 15: mod_base = OTHER; note = 2'-O-methyluridine-3'-phosphate
  modified_base 16: mod_base = OTHER; note = 2'-deoxy-2'-fluorouridine-3'-phosphate
  modified_base 17: mod_base = OTHER; note = 2'-O-methyluridine-3'-phosphate
  modified_base 18: mod_base = OTHER; note = 2'-deoxy-2'-fluoroadenosine-3'-phosphate
  modified_base 19: mod_base = OTHER; note = 2'-O-methyladenosine-3'-phosphate
  modified_base 20: mod_base = OTHER; note = 2'-deoxy-2'-fluoroguanosine-3'-phosphate
  modified_base 21: mod_base = OTHER; note = 2'-O-methylcytidine-3'-phosphorothioate
  modified_base 22: mod_base = OTHER; note = 2'-O-methyladenosine-3'-phosphorothioate
  modified_base 23: mod_base = OTHER; note = 2'-O-methyladenosine
agaatactgtcccttttaagcaa

SEQ ID NO: 61 - RNA, 23 nt, synthetic construct
  source 1..23: mol_type = other RNA
  modified_base 1: mod_base = OTHER; note = 2'-O-methyladenosine-3'-phosphorothioate
  modified_base 2: mod_base = OTHER; note = 2'-deoxy-2'-fluoroguanosine-3'-phosphorothioate
  modified_base 3: mod_base = OTHER; note = 2'-O-methyladenosine-3'-phosphate
  modified_base 4: mod_base = OTHER; note = 2'-deoxy-2'-fluoroadenosine-3'-phosphate
  modified_base 5: mod_base = OTHER; note = 2'-O-methyluridine-3'-phosphate
  modified_base 6: mod_base = OTHER; note = 2'-deoxy-2'-fluoroadenosine-3'-phosphate
  modified_base 7: mod_base = OTHER; note = 2'-O-methylcytidine-3'-phosphate
  modified_base 8: mod_base = OTHER; note = 2'-deoxy-2'-fluorouridine-3'-phosphate
  modified_base 9: mod_base = OTHER; note = 2'-O-methylguanosine-3'-phosphate
  modified_base 10: mod_base = OTHER; note = 2'-deoxy-2'-fluorouridine-3'-phosphate
  modified_base 11: mod_base = OTHER; note = 2'-O-methylcytidine-3'-phosphate
  modified_base 12: mod_base = OTHER; note = 2'-O-methylcytidine-3'-phosphate
  modified_base 13: mod_base = OTHER; note = 2'-O-methylcytidine-3'-phosphate
  modified_base 14: mod_base = OTHER; note = 2'-deoxy-2'-fluorouridine-3'-phosphate
  modified_base 15: mod_base = OTHER; note = 2'-O-methyluridine-3'-phosphate
  modified_base 16: mod_base = OTHER; note = 2'-deoxy-2'-fluorouridine-3'-phosphate
  modified_base 17: mod_base = OTHER; note = 2'-O-methyluridine-3'-phosphate
  modified_base 18: mod_base = OTHER; note = 2'-deoxy-2'-fluoroadenosine-3'-phosphate
  modified_base 19: mod_base = OTHER; note = 2'-O-methyladenosine-3'-phosphate
  modified_base 20: mod_base = OTHER; note = 2'-deoxy-2'-fluoroguanosine-3'-phosphate
  modified_base 21: mod_base = OTHER; note = 2'-O-methylcytidine-3'-phosphorothioate
  modified_base 22: mod_base = OTHER; note = 2'-O-methyladenosine-3'-phosphorothioate
  modified_base 23: mod_base = OTHER; note = 2'-O-methyladenosine
agaatactgtcccttttaagcaa

SEQ ID NO: 62 - RNA, 23 nt, synthetic construct
  source 1..23: mol_type = other RNA
  modified_base 1: mod_base = OTHER; note = 2'-O-methyladenosine-3'-phosphorothioate
  modified_base 2: mod_base = OTHER; note = 2'-deoxy-2'-fluoroguanosine-3'-phosphorothioate
  modified_base 3: mod_base = OTHER; note = 2'-O-methyladenosine-3'-phosphate
  modified_base 4: mod_base = OTHER; note = 2'-deoxy-2'-fluoroadenosine-3'-phosphate
  modified_base 5: mod_base = OTHER; note = 2'-O-methyluridine-3'-phosphate
  modified_base 6: mod_base = OTHER; note = 2'-deoxy-2'-fluoroadenosine-3'-phosphate
  modified_base 7: mod_base = OTHER; note = 2'-O-methylcytidine-3'-phosphate
  modified_base 8: mod_base = OTHER; note = 2'-deoxy-2'-fluorouridine-3'-phosphate
  modified_base 9: mod_base = OTHER; note = 2'-O-methylguanosine-3'-phosphate
  modified_base 10: mod_base = OTHER; note = 2'-deoxy-2'-fluorouridine-3'-phosphate
  modified_base 11: mod_base = OTHER; note = 2'-O-methylcytidine-3'-phosphate
  modified_base 12: mod_base = OTHER; note = 2'-O-methylcytidine-3'-phosphate
  modified_base 13: mod_base = OTHER; note = 2'-O-methylcytidine-3'-phosphate
  modified_base 14: mod_base = OTHER; note = 2'-deoxy-2'-fluorouridine-3'-phosphate
  modified_base 15: mod_base = OTHER; note = 2'-O-methyluridine-3'-phosphate
  modified_base 16: mod_base = OTHER; note = 2'-deoxy-2'-fluorouridine-3'-phosphate
  modified_base 17: mod_base = OTHER; note = 2'-O-methyluridine-3'-phosphate
  modified_base 18: mod_base = OTHER; note = 2'-deoxy-2'-fluoroadenosine-3'-phosphate
  modified_base 19: mod_base = OTHER; note = 2'-O-methyladenosine-3'-phosphate
  modified_base 20: mod_base = OTHER; note = 2'-deoxy-2'-fluoroguanosine-3'-phosphate
  modified_base 21: mod_base = OTHER; note = 2'-O-methylcytidine-3'-phosphorothioate
  modified_base 22: mod_base = OTHER; note = 2'-O-methyladenosine-3'-phosphorothioate
  modified_base 23: mod_base = OTHER; note = 2'-O-methyladenosine
agaatactgtcccttttaagcaa

SEQ ID NO: 63 - RNA, 23 nt, synthetic construct
  source 1..23: mol_type = other RNA
  modified_base 1: mod_base = OTHER; note = 2'-O-methyladenosine-3'-phosphorothioate
  modified_base 2: mod_base = OTHER; note = 2'-deoxy-2'-fluoroguanosine-3'-phosphorothioate
  modified_base 3: mod_base = OTHER; note = 2'-O-methyladenosine-3'-phosphate
  modified_base 4: mod_base = OTHER; note = 2'-deoxy-2'-fluoroadenosine-3'-phosphate
  modified_base 5: mod_base = OTHER; note = 2'-O-methyluridine-3'-phosphate
  modified_base 6: mod_base = OTHER; note = 2'-deoxy-2'-fluoroadenosine-3'-phosphate
  modified_base 7: mod_base = OTHER; note = 2'-O-methylcytidine-3'-phosphate
  modified_base 8: mod_base = OTHER; note = 2'-deoxy-2'-fluorouridine-3'-phosphate
  modified_base 9: mod_base = OTHER; note = 2'-O-methylguanosine-3'-phosphate
  modified_base 10: mod_base = OTHER; note = 2'-deoxy-2'-fluorouridine-3'-phosphate
  modified_base 11: mod_base = OTHER; note = 2'-O-methylcytidine-3'-phosphate
  modified_base 12: mod_base = OTHER; note = 2'-O-methylcytidine-3'-phosphate
  modified_base 13: mod_base = OTHER; note = 2'-O-methylcytidine-3'-phosphate
  modified_base 14: mod_base = OTHER; note = 2'-deoxy-2'-fluorouridine-3'-phosphate
  modified_base 15: mod_base = OTHER; note = 2'-O-methyluridine-3'-phosphate
  modified_base 16: mod_base = OTHER; note = 2'-deoxy-2'-fluorouridine-3'-phosphate
  modified_base 17: mod_base = OTHER; note = 2'-O-methyluridine-3'-phosphate
  modified_base 18: mod_base = OTHER; note = 2'-deoxy-2'-fluoroadenosine-3'-phosphate
  modified_base 19: mod_base = OTHER; note = 2'-O-methyladenosine-3'-phosphate
  modified_base 20: mod_base = OTHER; note = 2'-deoxy-2'-fluoroguanosine-3'-phosphate
  modified_base 21: mod_base = OTHER; note = 2'-O-methylcytidine-3'-phosphorothioate
  modified_base 22: mod_base = OTHER; note = 2'-O-methyladenosine-3'-phosphorothioate
  modified_base 23: mod_base = OTHER; note = 2'-O-methyladenosine
agaatactgtcccttttaagcaa

SEQ ID NO: 64 - RNA, 23 nt, synthetic construct
  source 1..23: mol_type = other RNA
  modified_base 1: mod_base = OTHER; note = 2'-O-methyladenosine-3'-phosphorothioate
  modified_base 2: mod_base = OTHER; note = 2'-deoxy-2'-fluoroguanosine-3'-phosphorothioate
  modified_base 3: mod_base = OTHER; note = 2'-O-methyladenosine-3'-phosphate
  modified_base 4: mod_base = OTHER; note = 2'-deoxy-2'-fluoroadenosine-3'-phosphate
  modified_base 5: mod_base = OTHER; note = 2'-O-methyluridine-3'-phosphate
  modified_base 6: mod_base = OTHER; note = 2'-deoxy-2'-fluoroadenosine-3'-phosphate
  modified_base 7: mod_base = OTHER; note = 2'-O-methylcytidine-3'-phosphate
  modified_base 8: mod_base = OTHER; note = 2'-deoxy-2'-fluorouridine-3'-phosphate
  modified_base 9: mod_base = OTHER; note = 2'-O-methylguanosine-3'-phosphate
  modified_base 10: mod_base = OTHER; note = 2'-deoxy-2'-fluorouridine-3'-phosphate
  modified_base 11: mod_base = OTHER; note = 2'-O-methylcytidine-3'-phosphate
  modified_base 12: mod_base = OTHER; note = 2'-O-methylcytidine-3'-phosphate
  modified_base 13: mod_base = OTHER; note = 2'-O-methylcytidine-3'-phosphate
  modified_base 14: mod_base = OTHER; note = 2'-deoxy-2'-fluorouridine-3'-phosphate
  modified_base 15: mod_base = OTHER; note = 2'-O-methyluridine-3'-phosphate
  modified_base 16: mod_base = OTHER; note = 2'-deoxy-2'-fluorouridine-3'-phosphate
  modified_base 17: mod_base = OTHER; note = 2'-O-methyluridine-3'-phosphate
  modified_base 18: mod_base = OTHER; note = 2'-deoxy-2'-fluoroadenosine-3'-phosphate
  modified_base 19: mod_base = OTHER; note = 2'-O-methyladenosine-3'-phosphate
  modified_base 20: mod_base = OTHER; note = 2'-deoxy-2'-fluoroguanosine-3'-phosphate
  modified_base 21: mod_base = OTHER; note = 2'-O-methylcytidine-3'-phosphorothioate
  modified_base 22: mod_base = OTHER; note = 2'-O-methyladenosine-3'-phosphorothioate
  modified_base 23: mod_base = OTHER; note = 2'-O-methyladenosine
agaatactgtcccttttaagcaa

SEQ ID NO: 65 - RNA, 23 nt, synthetic construct
  source 1..23: mol_type = other RNA
  modified_base 1: mod_base = OTHER; note = 2'-O-methyladenosine-3'-phosphorothioate
  modified_base 2: mod_base = OTHER; note = 2'-deoxy-2'-fluoroguanosine-3'-phosphorothioate
  modified_base 3: mod_base = OTHER; note = 2'-O-methyladenosine-3'-phosphate
  modified_base 4: mod_base = OTHER; note = 2'-deoxy-2'-fluoroadenosine-3'-phosphate
  modified_base 5: mod_base = OTHER; note = 2'-O-methyluridine-3'-phosphate
  modified_base 6: mod_base = OTHER; note = 2'-deoxy-2'-fluoroadenosine-3'-phosphate
  modified_base 7: mod_base = OTHER; note = 2'-O-methylcytidine-3'-phosphate
  modified_base 8: mod_base = OTHER; note = 2'-deoxy-2'-fluorouridine-3'-phosphate
  modified_base 9: mod_base = OTHER; note = 2'-O-methylguanosine-3'-phosphate
  modified_base 10: mod_base = OTHER; note = 2'-deoxy-2'-fluorouridine-3'-phosphate
  modified_base 11: mod_base = OTHER; note = 2'-O-methylcytidine-3'-phosphate
  modified_base 12: mod_base = OTHER; note = 2'-O-methylcytidine-3'-phosphate
  modified_base 13: mod_base = OTHER; note = 2'-O-methylcytidine-3'-phosphate
  modified_base 14: mod_base = OTHER; note = 2'-deoxy-2'-fluorouridine-3'-phosphate
  modified_base 15: mod_base = OTHER; note = 2'-O-methyluridine-3'-phosphate
  modified_base 16: mod_base = OTHER; note = 2'-deoxy-2'-fluorouridine-3'-phosphate
  modified_base 17: mod_base = OTHER; note = 2'-O-methyluridine-3'-phosphate
  modified_base 18: mod_base = OTHER; note = 2'-deoxy-2'-fluoroadenosine-3'-phosphate
  modified_base 19: mod_base = OTHER; note = 2'-O-methyladenosine-3'-phosphate
  modified_base 20: mod_base = OTHER; note = 2'-deoxy-2'-fluoroguanosine-3'-phosphate
  modified_base 21: mod_base = OTHER; note = 2'-O-methylcytidine-3'-phosphorothioate
  modified_base 22: mod_base = OTHER; note = 2'-O-methyladenosine-3'-phosphorothioate
  modified_base 23: mod_base = OTHER; note = 2'-O-methyladenosine
agaatactgtcccttttaagcaa

SEQ ID NO: 66 - RNA, 23 nt, synthetic construct
  source 1..23: mol_type = other RNA
  modified_base 1: mod_base = OTHER; note = 2'-O-methyladenosine-3'-phosphorothioate
  modified_base 2: mod_base = OTHER; note = 2'-deoxy-2'-fluoroguanosine-3'-phosphorothioate
  modified_base 3: mod_base = OTHER; note = 2'-O-methyladenosine-3'-phosphate
  modified_base 4: mod_base = OTHER; note = 2'-deoxy-2'-fluoroadenosine-3'-phosphate
  modified_base 5: mod_base = OTHER; note = 2'-O-methyluridine-3'-phosphate
  modified_base 6: mod_base = OTHER; note = 2'-deoxy-2'-fluoroadenosine-3'-phosphate
  modified_base 7: mod_base = OTHER; note = 2'-O-methylcytidine-3'-phosphate
  modified_base 8: mod_base = OTHER; note = 2'-deoxy-2'-fluorouridine-3'-phosphate
  modified_base 9: mod_base = OTHER; note = 2'-O-methylguanosine-3'-phosphate
  modified_base 10: mod_base = OTHER; note = 2'-deoxy-2'-fluorouridine-3'-phosphate
  modified_base 11: mod_base = OTHER; note = 2'-O-methylcytidine-3'-phosphate
  modified_base 12: mod_base = OTHER; note = 2'-O-methylcytidine-3'-phosphate
  modified_base 13: mod_base = OTHER; note = 2'-O-methylcytidine-3'-phosphate
  modified_base 14: mod_base = OTHER; note = 2'-deoxy-2'-fluorouridine-3'-phosphate
  modified_base 15: mod_base = OTHER; note = 2'-O-methyluridine-3'-phosphate
  modified_base 16: mod_base = OTHER; note = 2'-deoxy-2'-fluorouridine-3'-phosphate
  modified_base 17: mod_base = OTHER; note = 2'-O-methyluridine-3'-phosphate
  modified_base 18: mod_base = OTHER; note = 2'-deoxy-2'-fluoroadenosine-3'-phosphate
  modified_base 19: mod_base = OTHER; note = 2'-O-methyladenosine-3'-phosphate
  modified_base 20: mod_base = OTHER; note = 2'-deoxy-2'-fluoroguanosine-3'-phosphate
  modified_base 21: mod_base = OTHER; note = 2'-O-methylcytidine-3'-phosphorothioate
  modified_base 22: mod_base = OTHER; note = 2'-O-methyladenosine-3'-phosphorothioate
  modified_base 23: mod_base = OTHER; note = 2'-O-methyladenosine
agaatactgtcccttttaagcaa

SEQ ID NO: 67 - RNA, 23 nt, synthetic construct
  source 1..23: mol_type = other RNA
  modified_base 1: mod_base = OTHER; note = 2'-O-methyladenosine-3'-phosphorothioate
  modified_base 2: mod_base = OTHER; note = 2'-deoxy-2'-fluoroguanosine-3'-phosphorothioate
  modified_base 3: mod_base = OTHER; note = 2'-O-methyladenosine-3'-phosphate
  modified_base 4: mod_base = OTHER; note = 2'-deoxy-2'-fluoroadenosine-3'-phosphate
  modified_base 5: mod_base = OTHER; note = 2'-O-methyluridine-3'-phosphate
  modified_base 6: mod_base = OTHER; note = 2'-deoxy-2'-fluoroadenosine-3'-phosphate
  modified_base 7: mod_base = OTHER; note = 2'-O-methylcytidine-3'-phosphate
  modified_base 8: mod_base = OTHER; note = 2'-deoxy-2'-fluorouridine-3'-phosphate
  modified_base 9: mod_base = OTHER; note = 2'-O-methylguanosine-3'-phosphate
  modified_base 10: mod_base = OTHER; note = 2'-deoxy-2'-fluorouridine-3'-phosphate
  modified_base 11: mod_base = OTHER; note = 2'-O-methylcytidine-3'-phosphate
  modified_base 12: mod_base = OTHER; note = 2'-O-methylcytidine-3'-phosphate
  modified_base 13: mod_base = OTHER; note = 2'-O-methylcytidine-3'-phosphate
  modified_base 14: mod_base = OTHER; note = 2'-deoxy-2'-fluorouridine-3'-phosphate
  modified_base 15: mod_base = OTHER; note = 2'-O-methyluridine-3'-phosphate
  modified_base 16: mod_base = OTHER; note = 2'-deoxy-2'-fluorouridine-3'-phosphate
  modified_base 17: mod_base = OTHER; note = 2'-O-methyluridine-3'-phosphate
  modified_base 18: mod_base = OTHER; note = 2'-deoxy-2'-fluoroadenosine-3'-phosphate
  modified_base 19: mod_base = OTHER; note = 2'-O-methyladenosine-3'-phosphate
  modified_base 20: mod_base = OTHER; note = 2'-deoxy-2'-fluoroguanosine-3'-phosphate
  modified_base 21: mod_base = OTHER; note = 2'-O-methylcytidine-3'-phosphorothioate
  modified_base 22: mod_base = OTHER; note = 2'-O-methyladenosine-3'-phosphorothioate
  modified_base 23: mod_base = OTHER; note = 2'-O-methyladenosine
agaatactgtcccttttaagcaa

SEQ ID NO: 68 - RNA, 23 nt, synthetic construct
  source 1..23: mol_type = other RNA
  modified_base 1: mod_base = OTHER; note = 2'-O-methyluridine-3'-phosphorothioate
  modified_base 2: mod_base = OTHER; note = 2'-deoxy-2'-fluorocytidine-3'-phosphorothioate
  modified_base 3: mod_base = OTHER; note = 2'-O-methyluridine-3'-phosphate
  modified_base 4: mod_base = OTHER; note = 2'-deoxy-2'-fluorouridine-3'-phosphate
  modified_base 5: mod_base = OTHER; note = 2'-O-methylguanosine-3'-phosphate
  modified_base 6: mod_base = OTHER; note = 2'-deoxy-2'-fluoroguanosine-3'-phosphate
  modified_base 7: mod_base = OTHER; note = 2'-O-methyluridine-3'-phosphate
  modified_base 8: mod_base = OTHER; note = 2'-deoxy-2'-fluorouridine-3'-phosphate
  modified_base 9: mod_base = OTHER; note = 2'-O-methyladenosine-3'-phosphate
  modified_base 10: mod_base = OTHER; note = 2'-deoxy-2'-fluorocytidine-3'-phosphate
  modified_base 11: mod_base = OTHER; note = 2'-O-methyladenosine-3'-phosphate
  modified_base 12: mod_base = OTHER; note = 2'-O-methyluridine-3'-phosphate
  modified_base 13: mod_base = OTHER; note = 2'-O-methylguanosine-3'-phosphate
  modified_base 14: mod_base = OTHER; note = 2'-deoxy-2'-fluoroadenosine-3'-phosphate
  modified_base 15: mod_base = OTHER; note = 2'-O-methyladenosine-3'-phosphate
  modified_base 16: mod_base = OTHER; note = 2'-deoxy-2'-fluoroadenosine-3'-phosphate
  modified_base 17: mod_base = OTHER; note = 2'-O-methyluridine-3'-phosphate
  modified_base 18: mod_base = OTHER; note = 2'-deoxy-2'-fluorocytidine-3'-phosphate
  modified_base 19: mod_base = OTHER; note = 2'-O-methylcytidine-3'-phosphate
  modified_base 20: mod_base = OTHER; note = 2'-deoxy-2'-fluorocytidine-3'-phosphate
  modified_base 21: mod_base = OTHER; note = 2'-O-methyladenosine-3'-phosphorothioate
  modified_base 22: mod_base = OTHER; note = 2'-O-methyluridine-3'-phosphorothioate
  modified_base 23: mod_base = OTHER; note = 2'-O-methylcytidine
tcttggttacatgaaatcccatc

SEQ ID NO: 69 - RNA, 23 nt, synthetic construct
  source 1..23: mol_type = other RNA
  modified_base 1: mod_base = OTHER; note = 2'-O-methyluridine-3'-phosphorothioate
  modified_base 2: mod_base = OTHER; note = 2'-deoxy-2'-fluorocytidine-3'-phosphorothioate
  modified_base 3: mod_base = OTHER; note = 2'-O-methyluridine-3'-phosphate
  modified_base 4: mod_base = OTHER; note = 2'-deoxy-2'-fluorouridine-3'-phosphate
  modified_base 5: mod_base = OTHER; note = 2'-O-methylguanosine-3'-phosphate
  modified_base 6: mod_base = OTHER; note = 2'-deoxy-2'-fluoroguanosine-3'-phosphate
  modified_base 7: mod_base = OTHER; note = 2'-O-methyluridine-3'-phosphate
  modified_base 8: mod_base = OTHER; note = 2'-deoxy-2'-fluorouridine-3'-phosphate
  modified_base 9: mod_base = OTHER; note = 2'-O-methyladenosine-3'-phosphate
  modified_base 10: mod_base = OTHER; note = 2'-deoxy-2'-fluorocytidine-3'-phosphate
  modified_base 11: mod_base = OTHER; note = 2'-O-methyladenosine-3'-phosphate
  modified_base 12: mod_base = OTHER; note = 2'-O-methyluridine-3'-phosphate
  modified_base 13: mod_base = OTHER; note = 2'-O-methylguanosine-3'-phosphate
  modified_base 14: mod_base = OTHER; note = 2'-deoxy-2'-fluoroadenosine-3'-phosphate
  modified_base 15: mod_base = OTHER; note = 2'-O-methyladenosine-3'-phosphate
  modified_base 16: mod_base = OTHER; note = 2'-deoxy-2'-fluoroadenosine-3'-phosphate
  modified_base 17: mod_base = OTHER; note = 2'-O-methyluridine-3'-phosphate
  modified_base 18: mod_base = OTHER; note = 2'-deoxy-2'-fluorocytidine-3'-phosphate
  modified_base 19: mod_base = OTHER; note = 2'-O-methylcytidine-3'-phosphate
  modified_base 20: mod_base = OTHER; note = 2'-deoxy-2'-fluorocytidine-3'-phosphate
  modified_base 21: mod_base = OTHER; note = 2'-O-methyladenosine-3'-phosphorothioate
  modified_base 22: mod_base = OTHER; note = 2'-O-methyluridine-3'-phosphorothioate
  modified_base 23: mod_base = OTHER; note = 2'-O-methylcytidine
tcttggttacatgaaatcccatc

SEQ ID NO: 70 - RNA, 23 nt, synthetic construct
  source 1..23: mol_type = other RNA
  modified_base 1: mod_base = OTHER; note = 2'-O-methyluridine-3'-phosphorothioate
  modified_base 2: mod_base = OTHER; note = 2'-deoxy-2'-fluorocytidine-3'-phosphorothioate
  modified_base 3: mod_base = OTHER; note = 2'-O-methyluridine-3'-phosphate
  modified_base 4: mod_base = OTHER; note = 2'-deoxy-2'-fluorouridine-3'-phosphate
  modified_base 5: mod_base = OTHER; note = 2'-O-methylguanosine-3'-phosphate
  modified_base 6: mod_base = OTHER; note = 2'-deoxy-2'-fluoroguanosine-3'-phosphate
  modified_base 7: mod_base = OTHER; note = 2'-O-methyluridine-3'-phosphate
  modified_base 8: mod_base = OTHER; note = 2'-deoxy-2'-fluorouridine-3'-phosphate
  modified_base 9: mod_base = OTHER; note = 2'-O-methyladenosine-3'-phosphate
  modified_base 10: mod_base = OTHER; note = 2'-deoxy-2'-fluorocytidine-3'-phosphate
  modified_base 11: mod_base = OTHER; note = 2'-O-methyladenosine-3'-phosphate
  modified_base 12: mod_base = OTHER; note = 2'-O-methyluridine-3'-phosphate
  modified_base 13: mod_base = OTHER; note = 2'-O-methylguanosine-3'-phosphate
  modified_base 14: mod_base = OTHER; note = 2'-deoxy-2'-fluoroadenosine-3'-phosphate
  modified_base 15: mod_base = OTHER; note = 2'-O-methyladenosine-3'-phosphate
  modified_base 16: mod_base = OTHER; note = 2'-deoxy-2'-fluoroadenosine-3'-phosphate
  modified_base 17: mod_base = OTHER; note = 2'-O-methyluridine-3'-phosphate
  modified_base 18: mod_base = OTHER; note = 2'-deoxy-2'-fluorocytidine-3'-phosphate
  modified_base 19: mod_base = OTHER; note = 2'-O-methylcytidine-3'-phosphate
  modified_base 20: mod_base = OTHER; note = 2'-deoxy-2'-fluorocytidine-3'-phosphate
  modified_base 21: mod_base = OTHER; note = 2'-O-methyladenosine-3'-phosphorothioate
  modified_base 22: mod_base = OTHER; note = 2'-O-methyluridine-3'-phosphorothioate
  modified_base 23: mod_base = OTHER; note = 2'-O-methylcytidine
tcttggttacatgaaatcccatc

SEQ ID NO: 71 - RNA, 23 nt, synthetic construct
  source 1..23: mol_type = other RNA
  modified_base 1: mod_base = OTHER; note = 2'-O-methyluridine-3'-phosphorothioate
  modified_base 2: mod_base = OTHER; note = 2'-deoxy-2'-fluorocytidine-3'-phosphorothioate
  modified_base 3: mod_base = OTHER; note = 2'-O-methyluridine-3'-phosphate
  modified_base 4: mod_base = OTHER; note = 2'-deoxy-2'-fluorouridine-3'-phosphate
  modified_base 5: mod_base = OTHER; note = 2'-O-methylguanosine-3'-phosphate
  modified_base 6: mod_base = OTHER; note = 2'-deoxy-2'-fluoroguanosine-3'-phosphate
  modified_base 7: mod_base = OTHER; note = 2'-O-methyluridine-3'-phosphate
  modified_base 8: mod_base = OTHER; note = 2'-deoxy-2'-fluorouridine-3'-phosphate
  modified_base 9: mod_base = OTHER; note = 2'-O-methyladenosine-3'-phosphate
  modified_base 10: mod_base = OTHER; note = 2'-deoxy-2'-fluorocytidine-3'-phosphate
  modified_base 11: mod_base = OTHER; note = 2'-O-methyladenosine-3'-phosphate
  modified_base 12: mod_base = OTHER; note = 2'-O-methyluridine-3'-phosphate
  modified_base 13: mod_base = OTHER; note = 2'-O-methylguanosine-3'-phosphate
  modified_base 14: mod_base = OTHER; note = 2'-deoxy-2'-fluoroadenosine-3'-phosphate
  modified_base 15: mod_base = OTHER; note = 2'-O-methyladenosine-3'-phosphate
  modified_base 16: mod_base = OTHER; note = 2'-deoxy-2'-fluoroadenosine-3'-phosphate
  modified_base 17: mod_base = OTHER; note = 2'-O-methyluridine-3'-phosphate
  modified_base 18: mod_base = OTHER; note = 2'-deoxy-2'-fluorocytidine-3'-phosphate
  modified_base 19: mod_base = OTHER; note = 2'-O-methylcytidine-3'-phosphate
  modified_base 20: mod_base = OTHER; note = 2'-deoxy-2'-fluorocytidine-3'-phosphate
  modified_base 21: mod_base = OTHER; note = 2'-O-methyladenosine-3'-phosphorothioate
  modified_base 22: mod_base = OTHER; note = 2'-O-methyluridine-3'-phosphorothioate
  modified_base 23: mod_base = OTHER; note = 2'-O-methylcytidine
tcttggttacatgaaatcccatc

SEQ ID NO: 72 - RNA, 23 nt, synthetic construct
  source 1..23: mol_type = other RNA
  modified_base 1: mod_base = OTHER; note = 2'-O-methyluridine-3'-phosphorothioate
  modified_base 2: mod_base = OTHER; note = 2'-deoxy-2'-fluorocytidine-3'-phosphorothioate
  modified_base 3: mod_base = OTHER; note = 2'-O-methyluridine-3'-phosphate
  modified_base 4: mod_base = OTHER; note = 2'-deoxy-2'-fluorouridine-3'-phosphate
  modified_base 5: mod_base = OTHER; note = 2'-O-methylguanosine-3'-phosphate
  modified_base 6: mod_base = OTHER; note = 2'-deoxy-2'-fluoroguanosine-3'-phosphate
  modified_base 7: mod_base = OTHER; note = 2'-O-methyluridine-3'-phosphate
  modified_base 8: mod_base = OTHER; note = 2'-deoxy-2'-fluorouridine-3'-phosphate
  modified_base 9: mod_base = OTHER; note = 2'-O-methyladenosine-3'-phosphate
  modified_base 10: mod_base = OTHER; note = 2'-deoxy-2'-fluorocytidine-3'-phosphate
  modified_base 11: mod_base = OTHER; note = 2'-O-methyladenosine-3'-phosphate
  modified_base 12: mod_base = OTHER; note = 2'-O-methyluridine-3'-phosphate
  modified_base 13: mod_base = OTHER; note = 2'-O-methylguanosine-3'-phosphate
  modified_base 14: mod_base = OTHER; note = 2'-deoxy-2'-fluoroadenosine-3'-phosphate
  modified_base 15: mod_base = OTHER; note = 2'-O-methyladenosine-3'-phosphate
  modified_base 16: mod_base = OTHER; note = 2'-deoxy-2'-fluoroadenosine-3'-phosphate
  modified_base 17: mod_base = OTHER; note = 2'-O-methyluridine-3'-phosphate
  modified_base 18: mod_base = OTHER; note = 2'-deoxy-2'-fluorocytidine-3'-phosphate
  modified_base 19: mod_base = OTHER; note = 2'-O-methylcytidine-3'-phosphate
  modified_base 20: mod_base = OTHER; note = 2'-deoxy-2'-fluorocytidine-3'-phosphate
  modified_base 21: mod_base = OTHER; note = 2'-O-methyladenosine-3'-phosphorothioate
  modified_base 22: mod_base = OTHER; note = 2'-O-methyluridine-3'-phosphorothioate
  modified_base 23: mod_base = OTHER; note = 2'-O-methylcytidine
tcttggttacatgaaatcccatc

SEQ ID NO: 73 - RNA, 23 nt, synthetic construct
  source 1..23: mol_type = other RNA
  modified_base 1: mod_base = OTHER; note = 2'-O-methyluridine-3'-phosphorothioate
  modified_base 2: mod_base = OTHER; note = 2'-deoxy-2'-fluorocytidine-3'-phosphorothioate
  modified_base 3: mod_base = OTHER; note = 2'-O-methyluridine-3'-phosphate
  modified_base 4: mod_base = OTHER; note = 2'-deoxy-2'-fluorouridine-3'-phosphate
  modified_base 5: mod_base = OTHER; note = 2'-O-methylguanosine-3'-phosphate
  modified_base 6: mod_base = OTHER; note = 2'-deoxy-2'-fluoroguanosine-3'-phosphate
  modified_base 7: mod_base = OTHER; note = 2'-O-methyluridine-3'-phosphate
  modified_base 8: mod_base = OTHER; note = 2'-deoxy-2'-fluorouridine-3'-phosphate
  modified_base 9: mod_base = OTHER; note = 2'-O-methyladenosine-3'-phosphate
  modified_base 10: mod_base = OTHER; note = 2'-deoxy-2'-fluorocytidine-3'-phosphate
  modified_base 11: mod_base = OTHER; note = 2'-O-methyladenosine-3'-phosphate
  modified_base 12: mod_base = OTHER; note = 2'-O-methyluridine-3'-phosphate
  modified_base 13: mod_base = OTHER; note = 2'-O-methylguanosine-3'-phosphate
  modified_base 14: mod_base = OTHER; note = 2'-deoxy-2'-fluoroadenosine-3'-phosphate
  modified_base 15: mod_base = OTHER; note = 2'-O-methyladenosine-3'-phosphate
  modified_base 16: mod_base = OTHER; note = 2'-deoxy-2'-fluoroadenosine-3'-phosphate
  modified_base 17: mod_base = OTHER; note = 2'-O-methyluridine-3'-phosphate
  modified_base 18: mod_base = OTHER; note = 2'-deoxy-2'-fluorocytidine-3'-phosphate
  modified_base 19: mod_base = OTHER; note = 2'-O-methylcytidine-3'-phosphate
  modified_base 20: mod_base = OTHER; note = 2'-deoxy-2'-fluorocytidine-3'-phosphate
  modified_base 21: mod_base = OTHER; note = 2'-O-methyladenosine-3'-phosphorothioate
  modified_base 22: mod_base = OTHER; note = 2'-O-methyluridine-3'-phosphorothioate
  modified_base 23: mod_base = OTHER; note = 2'-O-methylcytidine
tcttggttacatgaaatcccatc

SEQ ID NO: 74 - RNA, 23 nt, synthetic construct
  source 1..23: mol_type = other RNA
  modified_base 1: mod_base = OTHER; note = 2'-O-methyluridine-3'-phosphorothioate
  modified_base 2: mod_base = OTHER; note = 2'-deoxy-2'-fluorocytidine-3'-phosphorothioate
  modified_base 3: mod_base = OTHER; note = 2'-O-methyluridine-3'-phosphate
  modified_base 4: mod_base = OTHER; note = 2'-deoxy-2'-fluorouridine-3'-phosphate
  modified_base 5: mod_base = OTHER; note = 2'-O-methylguanosine-3'-phosphate
  modified_base 6: mod_base = OTHER; note = 2'-deoxy-2'-fluoroguanosine-3'-phosphate
  modified_base 7: mod_base = OTHER; note = 2'-O-methyluridine-3'-phosphate
  modified_base 8: mod_base = OTHER; note = 2'-deoxy-2'-fluorouridine-3'-phosphate
  modified_base 9: mod_base = OTHER; note = 2'-O-methyladenosine-3'-phosphate
  modified_base 10: mod_base = OTHER; note = 2'-deoxy-2'-fluorocytidine-3'-phosphate
  modified_base 11: mod_base = OTHER; note = 2'-O-methyladenosine-3'-phosphate
  modified_base 12: mod_base = OTHER; note = 2'-O-methyluridine-3'-phosphate
  modified_base 13: mod_base = OTHER; note = 2'-O-methylguanosine-3'-phosphate
  modified_base 14: mod_base = OTHER; note = 2'-deoxy-2'-fluoroadenosine-3'-phosphate
  modified_base 15: mod_base = OTHER; note = 2'-O-methyladenosine-3'-phosphate
  modified_base 16: mod_base = OTHER; note = 2'-deoxy-2'-fluoroadenosine-3'-phosphate
  modified_base 17: mod_base = OTHER; note = 2'-O-methyluridine-3'-phosphate
  modified_base 18: mod_base = OTHER; note = 2'-deoxy-2'-fluorocytidine-3'-phosphate
  modified_base 19: mod_base = OTHER; note = 2'-O-methylcytidine-3'-phosphate
  modified_base 20: mod_base = OTHER; note = 2'-deoxy-2'-fluorocytidine-3'-phosphate
  modified_base 21: mod_base = OTHER; note = 2'-O-methyladenosine-3'-phosphorothioate
  modified_base 22: mod_base = OTHER; note = 2'-O-methyluridine-3'-phosphorothioate
  modified_base 23: mod_base = OTHER; note = 2'-O-methylcytidine
tcttggttacatgaaatcccatc

SEQ ID NO: 75 - RNA, 21 nt, synthetic construct
  source 1..21: mol_type = other RNA
  modified_base 1: mod_base = OTHER; note = 2'-deoxy-2'-fluoroadenosine-3'-phosphorothioate
  modified_base 2: mod_base = OTHER; note = 2'-O-methylcytidine-3'-phosphorothioate
  modified_base 3: mod_base = OTHER; note = 2'-deoxy-2'-fluoroadenosine-3'-phosphate
  modified_base 4: mod_base = OTHER; note = 2'-O-methyluridine-3'-phosphate
  modified_base 5: mod_base = OTHER; note = 2'-deoxy-2'-fluoroadenosine-3'-phosphate
  modified_base 6: mod_base = OTHER; note = 2'-O-methyluridine-3'-phosphate
  modified_base 7: mod_base = OTHER; note = 2'-deoxy-2'-fluorouridine-3'-phosphate
  modified_base 8: mod_base = OTHER; note = 2'-O-methyluridine-3'-phosphate
  modified_base 9: mod_base = OTHER; note = 2'-deoxy-2'-fluoroguanosine-3'-phosphate
  modified_base 10: mod_base = OTHER; note = 2'-deoxy-2'-fluoroadenosine-3'-phosphate
  modified_base 11: mod_base = OTHER; note = 2'-deoxy-2'-fluorouridine-3'-phosphate
  modified_base 12: mod_base = OTHER; note = 2'-O-methylcytidine-3'-phosphate
  modified_base 13: mod_base = OTHER; note = 2'-deoxy-2'-fluoroadenosine-3'-phosphate
  modified_base 14: mod_base = OTHER; note = 2'-O-methylguanosine-3'-phosphate
  modified_base 15: mod_base = OTHER; note = 2'-deoxy-2'-fluorouridine-3'-phosphate
  modified_base 16: mod_base = OTHER; note = 2'-O-methylcytidine-3'-phosphate
  modified_base 17: mod_base = OTHER; note = 2'-deoxy-2'-fluorouridine-3'-phosphate
  modified_base 18: mod_base = OTHER; note = 2'-O-methyluridine-3'-phosphate
  modified_base 19: mod_base = OTHER; note = 2'-deoxy-2'-fluorouridine-3'-phosphate
  modified_base 20: mod_base = OTHER; note = 2'-O-methyluridine-3'-phosphate
  modified_base 21: mod_base = OTHER; note = 2'-deoxy-2'-fluorouridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
acatatttgatcagtcttttt

SEQ ID NO: 76 - DNA, 21 bp, synthetic construct
  source 1..21: mol_type = other DNA
  modified_base 1: mod_base = OTHER; note = 2'-O-methyladenosine-3'-phosphorothioate
  modified_base 2: mod_base = OTHER; note = 2'-O-methylcytidine-3'-phosphorothioate
  modified_base 3: mod_base = OTHER; note = 2'-O-methyladenosine-3'-phosphate
  modified_base 4: mod_base = OTHER; note = 2'-O-methyluridine-3'-phosphate
  modified_base 5: mod_base = OTHER; note = 2'-O-methyladenosine-3'-phosphate
  modified_base 6: mod_base = OTHER; note = 2'-O-methyluridine-3'-phosphate
  modified_base 7: mod_base = OTHER; note = 2'-O-methyluridine-3'-phosphate
  modified_base 8: mod_base = OTHER; note = 2'-O-methyluridine-3'-phosphate
  modified_base 9: mod_base = OTHER; note = 2'-O-methylguanosine-3'-phosphate
  modified_base 10: mod_base = OTHER; note = 2'-O-methyladenosine-3'-phosphate
  modified_base 12: mod_base = OTHER; note = 2'-O-methylcytidine-3'-phosphate
  modified_base 13: mod_base = OTHER; note = 2'-O-methyladenosine-3'-phosphate
  modified_base 14: mod_base = OTHER; note = 2'-O-methylguanosine-3'-phosphate
  modified_base 15: mod_base = OTHER; note = 2'-O-methyluridine-3'-phosphate
  modified_base 16: mod_base = OTHER; note = Cytidine-glycol nucleic acid (GNA), S-isomer
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methyluridine-3'-phosphate
  modified_base 20: mod_base = OTHER; note = 2'-O-methyluridine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
  misc_feature 1..10: note = RNA
  misc_feature 12..21: note = RNA
  misc_feature 11: note = DNA
acatatttgatcagtcttttt

SEQ ID NO: 77 - DNA, 21 bp, synthetic construct
  source 1..21: mol_type = other DNA
  modified_base 1: mod_base = OTHER; note = 2'-O-methyladenosine-3'-phosphorothioate
  modified_base 2: mod_base = OTHER; note = 2'-O-methylcytidine-3'-phosphorothioate
  modified_base 3: mod_base = OTHER; note = 2'-O-methyladenosine-3'-phosphate
  modified_base 4: mod_base = OTHER; note = 2'-O-methyluridine-3'-phosphate
  modified_base 5: mod_base = OTHER; note = 2'-O-methyladenosine-3'-phosphate
  modified_base 6: mod_base = OTHER; note = 2'-O-methyluridine-3'-phosphate
  modified_base 7: mod_base = OTHER; note = 2'-O-methyluridine-3'-phosphate
  modified_base 8: mod_base = OTHER; note = 2'-O-methyluridine-3'-phosphate
  modified_base 9: mod_base = OTHER; note = 2'-O-methylguanosine-3'-phosphate
  modified_base 10: mod_base = OTHER; note = 2'-O-methyladenosine-3'-phosphate
  modified_base 12: mod_base = OTHER; note = 2'-O-methylcytidine-3'-phosphate
  modified_base 13: mod_base = OTHER; note = 2'-O-methyladenosine-3'-phosphate
  modified_base 14: mod_base = OTHER; note = 2'-O-methylguanosine-3'-phosphate
  modified_base 15: mod_base = OTHER; note = 2'-O-methyluridine-3'-phosphate
  modified_base 16: mod_base = OTHER; note = 2'-O-methylcytidine-3'-phosphate
  modified_base 17: mod_base = OTHER; note = Thymidine-glycol nucleic acid (GNA), S-Isomer
  modified_base 18: mod_base = OTHER; note = 2'-O-methyluridine-3'-phosphate
  modified_base 19: mod_base = OTHER; note = 2'-O-methyluridine-3'-phosphate
  modified_base 20: mod_base = OTHER; note = 2'-O-methyluridine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
  misc_feature 1..10: note = RNA
  misc_feature 12..21: note = RNA
  misc_feature 11: note = DNA
acatatttgatcagtcttttt

SEQ ID NO: 78 - DNA, 21 bp, synthetic construct
  source 1..21: mol_type = other DNA
  modified_base 1: mod_base = OTHER; note = 2'-O-methyladenosine-3'-phosphorothioate
  modified_base 2: mod_base = OTHER; note = 2'-O-methylcytidine-3'-phosphorothioate
  modified_base 3: mod_base = OTHER; note = 2'-O-methyladenosine-3'-phosphate
  modified_base 4: mod_base = OTHER; note = 2'-O-methyluridine-3'-phosphate
  modified_base 5: mod_base = OTHER; note = 2'-O-methyladenosine-3'-phosphate
  modified_base 6: mod_base = OTHER; note = 2'-O-methyluridine-3'-phosphate
  modified_base 7: mod_base = OTHER; note = 2'-O-methyluridine-3'-phosphate
  modified_base 8: mod_base = OTHER; note = 2'-O-methyluridine-3'-phosphate
  modified_base 9: mod_base = OTHER; note = 2'-O-methylguanosine-3'-phosphate
  modified_base 10: mod_base = OTHER; note = 2'-O-methyladenosine-3'-phosphate
  modified_base 12: mod_base = OTHER; note = 2'-O-methylcytidine-3'-phosphate
  modified_base 13: mod_base = OTHER; note = 2'-O-methyladenosine-3'-phosphate
  modified_base 14: mod_base = OTHER; note = 2'-O-methylguanosine-3'-phosphate
  modified_base 15: mod_base = OTHER; note = 2'-O-methyluridine-3'-phosphate
  modified_base 16: mod_base = OTHER; note = 2'-O-methylcytidine-3'-phosphate
  modified_base 17: mod_base = OTHER; note = 2'-O-methyluridine-3'-phosphate
  modified_base 18: mod_base = OTHER; note = Thymidine-glycol nucleic acid (GNA), S-Isomer
  modified_base 19: mod_base = OTHER; note = 2'-O-methyluridine-3'-phosphate
  modified_base 20: mod_base = OTHER; note = 2'-O-methyluridine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
  misc_feature 1..10: note = RNA
  misc_feature 12..21: note = RNA
  misc_feature 11: note = DNA
acatatttgatcagtcttttt

SEQ ID NO: 79 - RNA, 21 nt, synthetic construct
  source 1..21: mol_type = other RNA
  modified_base 1: mod_base = OTHER; note = 2'-deoxy-2'-fluoroguanosine-3'-phosphorothioate
  modified_base 2: mod_base = OTHER; note = 2'-O-methylcytidine-3'-phosphorothioate
  modified_base 3: mod_base = OTHER; note = 2'-deoxy-2'-fluorouridine-3'-phosphate
  modified_base 4: mod_base = OTHER; note = 2'-O-methyluridine-3'-phosphate
  modified_base 5: mod_base = OTHER; note = 2'-deoxy-2'-fluoroadenosine-3'-phosphate
  modified_base 6: mod_base = OTHER; note = 2'-O-methyladenosine-3'-phosphate
  modified_base 7: mod_base = OTHER; note = 2'-deoxy-2'-fluoroadenosine-3'-phosphate
  modified_base 8: mod_base = OTHER; note = 2'-O-methyladenosine-3'-phosphate
  modified_base 9: mod_base = OTHER; note = 2'-deoxy-2'-fluoroguanosine-3'-phosphate
  modified_base 10: mod_base = OTHER; note = 2'-deoxy-2'-fluoroguanosine-3'-phosphate
  modified_base 11: mod_base = OTHER; note = 2'-deoxy-2'-fluoroguanosine-3'-phosphate
  modified_base 12: mod_base = OTHER; note = 2'-O-methyladenosine-3'-phosphate
  modified_base 13: mod_base = OTHER; note = 2'-deoxy-2'-fluorocytidine-3'-phosphate
  modified_base 14: mod_base = OTHER; note = 2'-O-methyladenosine-3'-phosphate
  modified_base 15: mod_base = OTHER; note = 2'-deoxy-2'-fluoroguanosine-3'-phosphate
  modified_base 16: mod_base = OTHER; note = 2'-O-methyluridine-3'-phosphate
  modified_base 17: mod_base = OTHER; note = 2'-deoxy-2'-fluoroadenosine-3'-phosphate
  modified_base 18: mod_base = OTHER; note = 2'-O-methyluridine-3'-phosphate
  modified_base 19: mod_base = OTHER; note = 2'-deoxy-2'-fluorouridine-3'-phosphate
  modified_base 20: mod_base = OTHER; note = 2'-O-methylcytidine-3'-phosphate
  modified_base 21: mod_base = OTHER; note = 2'-deoxy-2'-fluorouridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
gcttaaaagggacagtattct

SEQ ID NO: 80 - DNA, 21 bp, synthetic construct
  source 1..21: mol_type = other DNA
  modified_base 1: mod_base = OTHER; note = 2'-O-methylguanosine-3'-phosphorothioate
  modified_base 2: mod_base = OTHER; note = 2'-O-methylcytidine-3'-phosphorothioate
  modified_base 3: mod_base = OTHER; note = 2'-O-methyluridine-3'-phosphate
  modified_base 4: mod_base = OTHER; note = 2'-O-methyluridine-3'-phosphate
  modified_base 5: mod_base = OTHER; note = 2'-O-methyladenosine-3'-phosphate
  modified_base 6: mod_base = OTHER; note = 2'-O-methyladenosine-3'-phosphate
  modified_base 7: mod_base = OTHER; note = 2'-O-methyladenosine-3'-phosphate
  modified_base 8: mod_base = OTHER; note = 2'-O-methyladenosine-3'-phosphate
  modified_base 9: mod_base = OTHER; note = 2'-O-methylguanosine-3'-phosphate
  modified_base 10: mod_base = OTHER; note = 2'-O-methylguanosine-3'-phosphate
  modified_base 12: mod_base = OTHER; note = 2'-O-methyladenosine-3'-phosphate
  modified_base 13: mod_base = OTHER; note = 2'-O-methylcytidine-3'-phosphate
  modified_base 14: mod_base = OTHER; note = 2'-O-methyladenosine-3'-phosphate
  modified_base 15: mod_base = OTHER; note = 2'-O-methylguanosine-3'-phosphate
  modified_base 16: mod_base = OTHER; note = Thymidine-glycol nucleic acid (GNA), S-Isomer
  modified_base 17: mod_base = OTHER; note = 2'-O-methyladenosine-3'-phosphate
  modified_base 18: mod_base = OTHER; note = 2'-O-methyluridine-3'-phosphate
  modified_base 19: mod_base = OTHER; note = 2'-O-methyluridine-3'-phosphate
  modified_base 20: mod_base = OTHER; note = 2'-O-methylcytidine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
  misc_feature 1..10: note = RNA
  misc_feature 12..21: note = RNA
  misc_feature 11: note = DNA
gcttaaaagggacagtattct

SEQ ID NO: 81 - DNA, 21 bp, synthetic construct
  source 1..21: mol_type = other DNA
  modified_base 1: mod_base = OTHER; note = 2'-O-methylguanosine-3'-phosphorothioate
  modified_base 2: mod_base = OTHER; note = 2'-O-methylcytidine-3'-phosphorothioate
  modified_base 3: mod_base = OTHER; note = 2'-O-methyluridine-3'-phosphate
  modified_base 4: mod_base = OTHER; note = 2'-O-methyluridine-3'-phosphate
  modified_base 5: mod_base = OTHER; note = 2'-O-methyladenosine-3'-phosphate
  modified_base 6: mod_base = OTHER; note = 2'-O-methyladenosine-3'-phosphate
  modified_base 7: mod_base = OTHER; note = 2'-O-methyladenosine-3'-phosphate
  modified_base 8: mod_base = OTHER; note = 2'-O-methyladenosine-3'-phosphate
  modified_base 9: mod_base = OTHER; note = 2'-O-methylguanosine-3'-phosphate
  modified_base 10: mod_base = OTHER; note = 2'-O-methylguanosine-3'-phosphate
  modified_base 12: mod_base = OTHER; note = 2'-O-methyladenosine-3'-phosphate
  modified_base 13: mod_base = OTHER; note = 2'-O-methylcytidine-3'-phosphate
  modified_base 14: mod_base = OTHER; note = 2'-O-methyladenosine-3'-phosphate
  modified_base 15: mod_base = OTHER; note = 2'-O-methylguanosine-3'-phosphate
  modified_base 16: mod_base = OTHER; note = 2'-O-methyluridine-3'-phosphate
  modified_base 17: mod_base = OTHER; note = Adenosine-glycol nucleic acid (GNA), S-isomer
  modified_base 18: mod_base = OTHER; note = 2'-O-methyluridine-3'-phosphate
  modified_base 19: mod_base = OTHER; note = 2'-O-methyluridine-3'-phosphate
  modified_base 20: mod_base = OTHER; note = 2'-O-methylcytidine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
  misc_feature 1..10: note = RNA
  misc_feature 12..21: note = RNA
  misc_feature 11: note = DNA
gcttaaaagggacagtattct

SEQ ID NO: 82 - DNA, 21 bp, synthetic construct
  source 1..21: mol_type = other DNA
  modified_base 1: mod_base = OTHER; note = 2'-O-methylguanosine-3'-phosphorothioate
  modified_base 2: mod_base = OTHER; note = 2'-O-methylcytidine-3'-phosphorothioate
  modified_base 3: mod_base = OTHER; note = 2'-O-methyluridine-3'-phosphate
  modified_base 4: mod_base = OTHER; note = 2'-O-methyluridine-3'-phosphate
  modified_base 5: mod_base = OTHER; note = 2'-O-methyladenosine-3'-phosphate
  modified_base 6: mod_base = OTHER; note = 2'-O-methyladenosine-3'-phosphate
  modified_base 7: mod_base = OTHER; note = 2'-O-methyladenosine-3'-phosphate
  modified_base 8: mod_base = OTHER; note = 2'-O-methyladenosine-3'-phosphate
  modified_base 9: mod_base = OTHER; note = 2'-O-methylguanosine-3'-phosphate
  modified_base 10: mod_base = OTHER; note = 2'-O-methylguanosine-3'-phosphate
  modified_base 12: mod_base = OTHER; note = 2'-O-methyladenosine-3'-phosphate
  modified_base 13: mod_base = OTHER; note = 2'-O-methylcytidine-3'-phosphate
  modified_base 14: mod_base = OTHER; note = 2'-O-methyladenosine-3'-phosphate
  modified_base 15: mod_base = OTHER; note = 2'-O-methylguanosine-3'-phosphate
  modified_base 16: mod_base = OTHER; note = 2'-O-methyluridine-3'-phosphate
  modified_base 17: mod_base = OTHER; note = 2'-O-methyladenosine-3'-phosphate
  modified_base 18: mod_base = OTHER; note = Thymidine-glycol nucleic acid (GNA), S-Isomer
  modified_base 19: mod_base = OTHER; note = 2'-O-methyluridine-3'-phosphate
  modified_base 20: mod_base = OTHER; note = 2'-O-methylcytidine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
  misc_feature 1..10: note = RNA
  misc_feature 12..21: note = RNA
  misc_feature 11: note = DNA
gcttaaaagggacagtattct

SEQ ID NO: 83 - RNA, 23 nt, synthetic construct
  source 1..23: mol_type = other RNA
  modified_base 1: mod_base = OTHER; note = 2'-O-methyladenosine-3'-phosphorothioate
  modified_base 2: mod_base = OTHER; note = 2'-deoxy-2'-fluoroadenosine-3'-phosphorothioate
  modified_base 3: mod_base = OTHER; note = 2'-O-methyladenosine-3'-phosphate
  modified_base 4: mod_base = OTHER; note = 2'-deoxy-2'-fluoroadenosine-3'-phosphate
  modified_base 5: mod_base = OTHER; note = 2'-O-methyladenosine-3'-phosphate
  modified_base 6: mod_base = OTHER; note = 2'-deoxy-2'-fluoroguanosine-3'-phosphate
  modified_base 7: mod_base = OTHER; note = 2'-O-methyladenosine-3'-phosphate
  modified_base 8: mod_base = OTHER; note = 2'-deoxy-2'-fluorocytidine-3'-phosphate
  modified_base 9: mod_base = OTHER; note = 2'-O-methyluridine-3'-phosphate
  modified_base 10: mod_base = OTHER; note = 2'-deoxy-2'-fluoroguanosine-3'-phosphate
  modified_base 11: mod_base = OTHER; note = 2'-O-methyladenosine-3'-phosphate
  modified_base 12: mod_base = OTHER; note = 2'-O-methyluridine-3'-phosphate
  modified_base 13: mod_base = OTHER; note = 2'-O-methylcytidine-3'-phosphate
  modified_base 14: mod_base = OTHER; note = 2'-deoxy-2'-fluoroadenosine-3'-phosphate
  modified_base 15: mod_base = OTHER; note = 2'-O-methyladenosine-3'-phosphate
  modified_base 16: mod_base = OTHER; note = 2'-deoxy-2'-fluoroadenosine-3'-phosphate
  modified_base 17: mod_base = OTHER; note = 2'-O-methyluridine-3'-phosphate
  modified_base 18: mod_base = OTHER; note = 2'-deoxy-2'-fluoroadenosine-3'-phosphate
  modified_base 19: mod_base = OTHER; note = 2'-O-methyluridine-3'-phosphate
  modified_base 20: mod_base = OTHER; note = 2'-deoxy-2'-fluoroguanosine-3'-phosphate
  modified_base 21: mod_base = OTHER; note = 2'-O-methyluridine-3'-phosphorothioate
  modified_base 22: mod_base = OTHER; note = 2'-O-methyluridine-3'-phosphorothioate
  modified_base 23: mod_base = OTHER; note = 2'-O-methylguanosine
aaaaagactgatcaaatatgttg

SEQ ID NO: 84 - RNA, 23 nt, synthetic construct
  source 1..23: mol_type = other RNA
  modified_base 1: mod_base = OTHER; note = 2'-O-methyladenosine-3'-phosphorothioate
  modified_base 2: mod_base = OTHER; note = 2'-deoxy-2'-fluoroadenosine-3'-phosphorothioate
  modified_base 3: mod_base = OTHER; note = 2'-O-methyladenosine-3'-phosphate
  modified_base 4: mod_base = OTHER; note = 2'-deoxy-2'-fluoroadenosine-3'-phosphate
  modified_base 5: mod_base = OTHER; note = 2'-O-methyladenosine-3'-phosphate
  modified_base 6: mod_base = OTHER; note = 2'-deoxy-2'-fluoroguanosine-3'-phosphate
  modified_base 7: mod_base = OTHER; note = 2'-O-methyladenosine-3'-phosphate
  modified_base 8: mod_base = OTHER; note = 2'-deoxy-2'-fluorocytidine-3'-phosphate
  modified_base 9: mod_base = OTHER; note = 2'-O-methyluridine-3'-phosphate
  modified_base 10: mod_base = OTHER; note = 2'-deoxy-2'-fluoroguanosine-3'-phosphate
  modified_base 11: mod_base = OTHER; note = 2'-O-methyladenosine-3'-phosphate
  modified_base 12: mod_base = OTHER; note = 2'-O-methyluridine-3'-phosphate
  modified_base 13: mod_base = OTHER; note = 2'-O-methylcytidine-3'-phosphate
  modified_base 14: mod_base = OTHER; note = 2'-deoxy-2'-fluoroadenosine-3'-phosphate
  modified_base 15: mod_base = OTHER; note = 2'-O-methyladenosine-3'-phosphate
  modified_base 16: mod_base = OTHER; note = 2'-deoxy-2'-fluoroadenosine-3'-phosphate
  modified_base 17: mod_base = OTHER; note = 2'-O-methyluridine-3'-phosphate
  modified_base 18: mod_base = OTHER; note = 2'-deoxy-2'-fluoroadenosine-3'-phosphate
  modified_base 19: mod_base = OTHER; note = 2'-O-methyluridine-3'-phosphate
  modified_base 20: mod_base = OTHER; note = 2'-deoxy-2'-fluoroguanosine-3'-phosphate
  modified_base 21: mod_base = OTHER; note = 2'-O-methyluridine-3'-phosphorothioate
  modified_base 22: mod_base = OTHER; note = 2'-O-methyluridine-3'-phosphorothioate
  modified_base 23: mod_base = OTHER; note = 2'-O-methylguanosine
aaaaagactgatcaaatatgttg

SEQ ID NO: 85 - RNA, 23 nt, synthetic construct
  source 1..23: mol_type = other RNA
  modified_base 1: mod_base = OTHER; note = 2'-O-methyladenosine-3'-phosphorothioate
  modified_base 2: mod_base = OTHER; note = 2'-deoxy-2'-fluoroadenosine-3'-phosphorothioate
  modified_base 3: mod_base = OTHER; note = 2'-O-methyladenosine-3'-phosphate
  modified_base 4: mod_base = OTHER; note = 2'-deoxy-2'-fluoroadenosine-3'-phosphate
  modified_base 5: mod_base = OTHER; note = 2'-O-methyladenosine-3'-phosphate
  modified_base 6: mod_base = OTHER; note = 2'-deoxy-2'-fluoroguanosine-3'-phosphate
  modified_base 7: mod_base = OTHER; note = 2'-O-methyladenosine-3'-phosphate
  modified_base 8: mod_base = OTHER; note = 2'-deoxy-2'-fluorocytidine-3'-phosphate
  modified_base 9: mod_base = OTHER; note = 2'-O-methyluridine-3'-phosphate
  modified_base 10: mod_base = OTHER; note = 2'-deoxy-2'-fluoroguanosine-3'-phosphate
  modified_base 11: mod_base = OTHER; note = 2'-O-methyladenosine-3'-phosphate
  modified_base 12: mod_base = OTHER; note = 2'-O-methyluridine-3'-phosphate
  modified_base 13: mod_base = OTHER; note = 2'-O-methylcytidine-3'-phosphate
  modified_base 14: mod_base = OTHER; note = 2'-deoxy-2'-fluoroadenosine-3'-phosphate
  modified_base 15: mod_base = OTHER; note = 2'-O-methyladenosine-3'-phosphate
  modified_base 16: mod_base = OTHER; note = 2'-deoxy-2'-fluoroadenosine-3'-phosphate
  modified_base 17: mod_base = OTHER; note = 2'-O-methyluridine-3'-phosphate
  modified_base 18: mod_base = OTHER; note = 2'-deoxy-2'-fluoroadenosine-3'-phosphate
  modified_base 19: mod_base = OTHER; note = 2'-O-methyluridine-3'-phosphate
  modified_base 20: mod_base = OTHER; note = 2'-deoxy-2'-fluoroguanosine-3'-phosphate
  modified_base 21: mod_base = OTHER; note = 2'-O-methyluridine-3'-phosphorothioate
  modified_base 22: mod_base = OTHER; note = 2'-O-methyluridine-3'-phosphorothioate
  modified_base 23: mod_base = OTHER; note = 2'-O-methylguanosine
aaaaagactgatcaaatatgttg

SEQ ID NO: 86 - RNA, 23 nt, synthetic construct
  source 1..23: mol_type = other RNA
  modified_base 1: mod_base = OTHER; note = 2'-O-methyladenosine-3'-phosphorothioate
  modified_base 2: mod_base = OTHER; note = 2'-deoxy-2'-fluoroadenosine-3'-phosphorothioate
  modified_base 3: mod_base = OTHER; note = 2'-O-methyladenosine-3'-phosphate
  modified_base 4: mod_base = OTHER; note = 2'-deoxy-2'-fluoroadenosine-3'-phosphate
  modified_base 5: mod_base = OTHER; note = 2'-O-methyladenosine-3'-phosphate
  modified_base 6: mod_base = OTHER; note = 2'-deoxy-2'-fluoroguanosine-3'-phosphate
  modified_base 7: mod_base = OTHER; note = 2'-O-methyladenosine-3'-phosphate
  modified_base 8: mod_base = OTHER; note = 2'-deoxy-2'-fluorocytidine-3'-phosphate
  modified_base 9: mod_base = OTHER; note = 2'-O-methyluridine-3'-phosphate
  modified_base 10: mod_base = OTHER; note = 2'-deoxy-2'-fluoroguanosine-3'-phosphate
  modified_base 11: mod_base = OTHER; note = 2'-O-methyladenosine-3'-phosphate
  modified_base 12: mod_base = OTHER; note = 2'-O-methyluridine-3'-phosphate
  modified_base 13: mod_base = OTHER; note = 2'-O-methylcytidine-3'-phosphate
  modified_base 14: mod_base = OTHER; note = 2'-deoxy-2'-fluoroadenosine-3'-phosphate
  modified_base 15: mod_base = OTHER; note = 2'-O-methyladenosine-3'-phosphate
  modified_base 16: mod_base = OTHER; note = 2'-deoxy-2'-fluoroadenosine-3'-phosphate
  modified_base 17: mod_base = OTHER; note = 2'-O-methyluridine-3'-phosphate
  modified_base 18: mod_base = OTHER; note = 2'-deoxy-2'-fluoroadenosine-3'-phosphate
  modified_base 19: mod_base = OTHER; note = 2'-O-methyluridine-3'-phosphate
  modified_base 20: mod_base = OTHER; note = 2'-deoxy-2'-fluoroguanosine-3'-phosphate
  modified_base 21: mod_base = OTHER; note = 2'-O-methyluridine-3'-phosphorothioate
  modified_base 22: mod_base = OTHER; note = 2'-O-methyluridine-3'-phosphorothioate
  modified_base 23: mod_base = OTHER; note = 2'-O-methylguanosine
aaaaagactgatcaaatatgttg

SEQ ID NO: 87 - RNA, 23 nt, synthetic construct
  source 1..23: mol_type = other RNA
  modified_base 1: mod_base = OTHER; note = 2'-O-methyladenosine-3'-phosphorothioate
  modified_base 2: mod_base = OTHER; note = 2'-deoxy-2'-fluoroguanosine-3'-phosphorothioate
  modified_base 3: mod_base = OTHER; note = 2'-O-methyladenosine-3'-phosphate
  modified_base 4: mod_base = OTHER; note = 2'-deoxy-2'-fluoroadenosine-3'-phosphate
  modified_base 5: mod_base = OTHER; note = 2'-O-methyluridine-3'-phosphate
  modified_base 6: mod_base = OTHER; note = 2'-deoxy-2'-fluoroadenosine-3'-phosphate
  modified_base 7: mod_base = OTHER; note = 2'-O-methylcytidine-3'-phosphate
  modified_base 8: mod_base = OTHER; note = 2'-deoxy-2'-fluorouridine-3'-phosphate
  modified_base 9: mod_base = OTHER; note = 2'-O-methylguanosine-3'-phosphate
  modified_base 10: mod_base = OTHER; note = 2'-deoxy-2'-fluorouridine-3'-phosphate
  modified_base 11: mod_base = OTHER; note = 2'-O-methylcytidine-3'-phosphate
  modified_base 12: mod_base = OTHER; note = 2'-O-methylcytidine-3'-phosphate
  modified_base 13: mod_base = OTHER; note = 2'-O-methylcytidine-3'-phosphate
  modified_base 14: mod_base = OTHER; note = 2'-deoxy-2'-fluorouridine-3'-phosphate
  modified_base 15: mod_base = OTHER; note = 2'-O-methyluridine-3'-phosphate
  modified_base 16: mod_base = OTHER; note = 2'-deoxy-2'-fluorouridine-3'-phosphate
  modified_base 17: mod_base = OTHER; note = 2'-O-methyluridine-3'-phosphate
  modified_base 18: mod_base = OTHER; note = 2'-deoxy-2'-fluoroadenosine-3'-phosphate
  modified_base 19: mod_base = OTHER; note = 2'-O-methyladenosine-3'-phosphate
  modified_base 20: mod_base = OTHER; note = 2'-deoxy-2'-fluoroguanosine-3'-phosphate
  modified_base 21: mod_base = OTHER; note = 2'-O-methylcytidine-3'-phosphorothioate
  modified_base 22: mod_base = OTHER; note = 2'-O-methyladenosine-3'-phosphorothioate
  modified_base 23: mod_base = OTHER; note = 2'-O-methyladenosine
agaatactgtcccttttaagcaa

SEQ ID NO: 88 - RNA, 23 nt, synthetic construct
  source 1..23: mol_type = other RNA
  modified_base 1: mod_base = OTHER; note = 2'-O-methyladenosine-3'-phosphorothioate
  modified_base 2: mod_base = OTHER; note = 2'-deoxy-2'-fluoroguanosine-3'-phosphorothioate
  modified_base 3: mod_base = OTHER; note = 2'-O-methyladenosine-3'-phosphate
  modified_base 4: mod_base = OTHER; note = 2'-deoxy-2'-fluoroadenosine-3'-phosphate
  modified_base 5: mod_base = OTHER; note = 2'-O-methyluridine-3'-phosphate
  modified_base 6: mod_base = OTHER; note = 2'-deoxy-2'-fluoroadenosine-3'-phosphate
  modified_base 7: mod_base = OTHER; note = 2'-O-methylcytidine-3'-phosphate
  modified_base 8: mod_base = OTHER; note = 2'-deoxy-2'-fluorouridine-3'-phosphate
  modified_base 9: mod_base = OTHER; note = 2'-O-methylguanosine-3'-phosphate
  modified_base 10: mod_base = OTHER; note = 2'-deoxy-2'-fluorouridine-3'-phosphate
  modified_base 11: mod_base = OTHER; note = 2'-O-methylcytidine-3'-phosphate
  modified_base 12: mod_base = OTHER; note = 2'-O-methylcytidine-3'-phosphate
  modified_base 13: mod_base = OTHER; note = 2'-O-methylcytidine-3'-phosphate
  modified_base 14: mod_base = OTHER; note = 2'-deoxy-2'-fluorouridine-3'-phosphate
  modified_base 15: mod_base = OTHER; note = 2'-O-methyluridine-3'-phosphate
  modified_base 16: mod_base = OTHER; note = 2'-deoxy-2'-fluorouridine-3'-phosphate
  modified_base 17: mod_base = OTHER; note = 2'-O-methyluridine-3'-phosphate
  modified_base 18: mod_base = OTHER; note = 2'-deoxy-2'-fluoroadenosine-3'-phosphate
  modified_base 19: mod_base = OTHER; note = 2'-O-methyladenosine-3'-phosphate
  modified_base 20: mod_base = OTHER; note = 2'-deoxy-2'-fluoroguanosine-3'-phosphate
  modified_base 21: mod_base = OTHER; note = 2'-O-methylcytidine-3'-phosphorothioate
  modified_base 22: mod_base = OTHER; note = 2'-O-methyladenosine-3'-phosphorothioate
  modified_base 23: mod_base = OTHER; note = 2'-O-methyladenosine
agaatactgtcccttttaagcaa

SEQ ID NO: 89 - RNA, 23 nt, synthetic construct
  source 1..23: mol_type = other RNA
  modified_base 1: mod_base = OTHER; note = 2'-O-methyladenosine-3'-phosphorothioate
  modified_base 2: mod_base = OTHER; note = 2'-deoxy-2'-fluoroguanosine-3'-phosphorothioate
  modified_base 3: mod_base = OTHER; note = 2'-O-methyladenosine-3'-phosphate
  modified_base 4: mod_base = OTHER; note = 2'-deoxy-2'-fluoroadenosine-3'-phosphate
  modified_base 5: mod_base = OTHER; note = 2'-O-methyluridine-3'-phosphate
  modified_base 6: mod_base = OTHER; note = 2'-deoxy-2'-fluoroadenosine-3'-phosphate
  modified_base 7: mod_base = OTHER; note = 2'-O-methylcytidine-3'-phosphate
  modified_base 8: mod_base = OTHER; note = 2'-deoxy-2'-fluorouridine-3'-phosphate
  modified_base 9: mod_base = OTHER; note = 2'-O-methylguanosine-3'-phosphate
  modified_base 10: mod_base = OTHER; note = 2'-deoxy-2'-fluorouridine-3'-phosphate
  modified_base 11: mod_base = OTHER; note = 2'-O-methylcytidine-3'-phosphate
  modified_base 12: mod_base = OTHER; note = 2'-O-methylcytidine-3'-phosphate
  modified_base 13: mod_base = OTHER; note = 2'-O-methylcytidine-3'-phosphate
  modified_base 14: mod_base = OTHER; note = 2'-deoxy-2'-fluorouridine-3'-phosphate
  modified_base 15: mod_base = OTHER; note = 2'-O-methyluridine-3'-phosphate
  modified_base 16: mod_base = OTHER; note = 2'-deoxy-2'-fluorouridine-3'-phosphate
  modified_base 17: mod_base = OTHER; note = 2'-O-methyluridine-3'-phosphate
  modified_base 18: mod_base = OTHER; note = 2'-deoxy-2'-fluoroadenosine-3'-phosphate
  modified_base 19: mod_base = OTHER; note = 2'-O-methyladenosine-3'-phosphate
  modified_base 20: mod_base = OTHER; note = 2'-deoxy-2'-fluoroguanosine-3'-phosphate
  modified_base 21: mod_base = OTHER; note = 2'-O-methylcytidine-3'-phosphorothioate
  modified_base 22: mod_base = OTHER; note = 2'-O-methyladenosine-3'-phosphorothioate
  modified_base 23: mod_base = OTHER; note = 2'-O-methyladenosine
agaatactgtcccttttaagcaa

SEQ ID NO: 90 - RNA, 23 nt, synthetic construct
  source 1..23: mol_type = other RNA
  modified_base 1: mod_base = OTHER; note = 2'-O-methyladenosine-3'-phosphorothioate
  modified_base 2: mod_base = OTHER; note = 2'-deoxy-2'-fluoroguanosine-3'-phosphorothioate
  modified_base 3: mod_base = OTHER; note = 2'-O-methyladenosine-3'-phosphate
  modified_base 4: mod_base = OTHER; note = 2'-deoxy-2'-fluoroadenosine-3'-phosphate
  modified_base 5: mod_base = OTHER; note = 2'-O-methyluridine-3'-phosphate
  modified_base 6: mod_base = OTHER; note = 2'-deoxy-2'-fluoroadenosine-3'-phosphate
  modified_base 7: mod_base = OTHER; note = 2'-O-methylcytidine-3'-phosphate
  modified_base 8: mod_base = OTHER; note = 2'-deoxy-2'-fluorouridine-3'-phosphate
  modified_base 9: mod_base = OTHER; note = 2'-O-methylguanosine-3'-phosphate
  modified_base 10: mod_base = OTHER; note = 2'-deoxy-2'-fluorouridine-3'-phosphate
  modified_base 11: mod_base = OTHER; note = 2'-O-methylcytidine-3'-phosphate
  modified_base 12: mod_base = OTHER; note = 2'-O-methylcytidine-3'-phosphate
  modified_base 13: mod_base = OTHER; note = 2'-O-methylcytidine-3'-phosphate
  modified_base 14: mod_base = OTHER; note = 2'-deoxy-2'-fluorouridine-3'-phosphate
  modified_base 15: mod_base = OTHER; note = 2'-O-methyluridine-3'-phosphate
  modified_base 16: mod_base = OTHER; note = 2'-deoxy-2'-fluorouridine-3'-phosphate
  modified_base 17: mod_base = OTHER; note = 2'-O-methyluridine-3'-phosphate
  modified_base 18: mod_base = OTHER; note = 2'-deoxy-2'-fluoroadenosine-3'-phosphate
  modified_base 19: mod_base = OTHER; note = 2'-O-methyladenosine-3'-phosphate
  modified_base 20: mod_base = OTHER; note = 2'-deoxy-2'-fluoroguanosine-3'-phosphate
  modified_base 21: mod_base = OTHER; note = 2'-O-methylcytidine-3'-phosphorothioate
  modified_base 22: mod_base = OTHER; note = 2'-O-methyladenosine-3'-phosphorothioate
  modified_base 23: mod_base = OTHER; note = 2'-O-methyladenosine
agaatactgtcccttttaagcaa

SEQ ID NO: 91 - RNA, 21 nt, synthetic construct
  source 1..21: mol_type = other RNA
  modified_base 1: mod_base = OTHER; note = 2'-deoxy-2'-fluoroadenosine-3'-phosphorothioate
  modified_base 2: mod_base = OTHER; note = 2'-O-methyladenosine-3'-phosphorothioate
  modified_base 3: mod_base = OTHER; note = 2'-deoxy-2'-fluorocytidine-3'-phosphate
  modified_base 4: mod_base = OTHER; note = 2'-O-methyladenosine-3'-phosphate
  modified_base 5: mod_base = OTHER; note = 2'-deoxy-2'-fluoroguanosine-3'-phosphate
  modified_base 6: mod_base = OTHER; note = 2'-O-methyluridine-3'-phosphate
  modified_base 7: mod_base = OTHER; note = 2'-deoxy-2'-fluoroguanosine-3'-phosphate
  modified_base 8: mod_base = OTHER; note = 2'-O-methyluridine-3'-phosphate
  modified_base 9: mod_base = OTHER; note = 2'-deoxy-2'-fluorouridine-3'-phosphate
  modified_base 10: mod_base = OTHER; note = 2'-deoxy-2'-fluorocytidine-3'-phosphate
  modified_base 11: mod_base = OTHER; note = 2'-deoxy-2'-fluorouridine-3'-phosphate
  modified_base 12: mod_base = OTHER; note = 2'-O-methyluridine-3'-phosphate
  modified_base 13: mod_base = OTHER; note = 2'-deoxy-2'-fluoroguanosine-3'-phosphate
  modified_base 14: mod_base = OTHER; note = 2'-O-methylcytidine-3'-phosphate
  modified_base 15: mod_base = OTHER; note = 2'-deoxy-2'-fluorouridine-3'-phosphate
  modified_base 16: mod_base = OTHER; note = 2'-O-methylcytidine-3'-phosphate
  modified_base 17: mod_base = OTHER; note = 2'-deoxy-2'-fluorouridine-3'-phosphate
  modified_base 18: mod_base = OTHER; note = 2'-O-methyladenosine-3'-phosphate
  modified_base 19: mod_base = OTHER; note = 2'-deoxy-2'-fluorouridine-3'-phosphate
  modified_base 20: mod_base = OTHER; note = 2'-O-methyladenosine-3'-phosphate
  modified_base 21: mod_base = OTHER; note = 2'-deoxy-2'-fluoroadenosine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
aacagtgttcttgctctataa

SEQ ID NO: 92 - DNA, 21 bp, synthetic construct
  source 1..21: mol_type = other DNA
  modified_base 1: mod_base = OTHER; note = 2'-O-methyladenosine-3'-phosphorothioate
  modified_base 2: mod_base = OTHER; note = 2'-O-methyladenosine-3'-phosphorothioate
  modified_base 3: mod_base = OTHER; note = 2'-O-methylcytidine-3'-phosphate
  modified_base 4: mod_base = OTHER; note = 2'-O-methyladenosine-3'-phosphate
  modified_base 5: mod_base = OTHER; note = 2'-O-methylguanosine-3'-phosphate
  modified_base 6: mod_base = OTHER; note = 2'-O-methyluridine-3'-phosphate
  modified_base 7: mod_base = OTHER; note = 2'-O-methylguanosine-3'-phosphate
  modified_base 8: mod_base = OTHER; note = 2'-O-methyluridine-3'-phosphate
  modified_base 9: mod_base = OTHER; note = 2'-O-methyluridine-3'-phosphate
  modified_base 10: mod_base = OTHER; note = 2'-O-methylcytidine-3'-phosphate
  modified_base 12: mod_base = OTHER; note = 2'-O-methyluridine-3'-phosphate
  modified_base 13: mod_base = OTHER; note = 2'-O-methylguanosine-3'-phosphate
  modified_base 14: mod_base = OTHER; note = 2'-O-methylcytidine-3'-phosphate
  modified_base 15: mod_base = OTHER; note = 2'-O-methyluridine-3'-phosphate
  modified_base 16: mod_base = OTHER; note = 2'-O-methylcytidine-3'-phosphate
  modified_base 17: mod_base = OTHER; note = Thymidine-glycol nucleic acid (GNA), S-Isomer
  modified_base 18: mod_base = OTHER; note = 2'-O-methyladenosine-3'-phosphate
  modified_base 19: mod_base = OTHER; note = 2'-O-methyluridine-3'-phosphate
  modified_base 20: mod_base = OTHER; note = 2'-O-methyladenosine-3'-phosphate
  modified_base 21: mod_base = OTHER; note = 2'-O-methyladenosine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
  misc_feature 1..10: note = RNA
  misc_feature 12..21: note = RNA
  misc_feature 11: note = DNA
aacagtgttcttgctctataa

SEQ ID NO: 93 - DNA, 21 bp, synthetic construct
  source 1..21: mol_type = other DNA
  modified_base 1: mod_base = OTHER; note = 2'-O-methyladenosine-3'-phosphorothioate
  modified_base 2: mod_base = OTHER; note = 2'-O-methyladenosine-3'-phosphorothioate
  modified_base 3: mod_base = OTHER; note = 2'-O-methylcytidine-3'-phosphate
  modified_base 4: mod_base = OTHER; note = 2'-O-methyladenosine-3'-phosphate
  modified_base 5: mod_base = OTHER; note = 2'-O-methylguanosine-3'-phosphate
  modified_base 6: mod_base = OTHER; note = 2'-O-methyluridine-3'-phosphate
  modified_base 7: mod_base = OTHER; note = 2'-O-methylguanosine-3'-phosphate
  modified_base 8: mod_base = OTHER; note = 2'-O-methyluridine-3'-phosphate
  modified_base 9: mod_base = OTHER; note = 2'-O-methyluridine-3'-phosphate
  modified_base 10: mod_base = OTHER; note = 2'-O-methylcytidine-3'-phosphate
  modified_base 12: mod_base = OTHER; note = 2'-O-methyluridine-3'-phosphate
  modified_base 13: mod_base = OTHER; note = 2'-O-methylguanosine-3'-phosphate
  modified_base 14: mod_base = OTHER; note = 2'-O-methylcytidine-3'-phosphate
  modified_base 15: mod_base = OTHER; note = 2'-O-methyluridine-3'-phosphate
  modified_base 16: mod_base = OTHER; note = 2'-O-methylcytidine-3'-phosphate
  modified_base 17: mod_base = OTHER; note = Thymidine-glycol nucleic acid (GNA), S-Isomer
  modified_base 18: mod_base = OTHER; note = 2'-O-methyladenosine-3'-phosphate
  modified_base 19: mod_base = OTHER; note = 2'-O-methyluridine-3'-phosphate
  modified_base 20: mod_base = OTHER; note = 2'-O-methyladenosine-3'-phosphate
  modified_base 21: mod_base = OTHER; note = 2'-O-methyladenosine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
  misc_feature 1..10: note = RNA
  misc_feature 12..21: note = RNA
  misc_feature 11: note = DNA
aacagtgttcttgctctataa

SEQ ID NO: 94 - DNA, 21 bp, synthetic construct
  source 1..21: mol_type = other DNA
  modified_base 1: mod_base = OTHER; note = 2'-O-methyladenosine-3'-phosphorothioate
  modified_base 2: mod_base = OTHER; note = 2'-O-methyladenosine-3'-phosphorothioate
  modified_base 3: mod_base = OTHER; note = 2'-O-methylcytidine-3'-phosphate
  modified_base 4: mod_base = OTHER; note = 2'-O-methyladenosine-3'-phosphate
  modified_base 5: mod_base = OTHER; note = 2'-O-methylguanosine-3'-phosphate
  modified_base 6: mod_base = OTHER; note = 2'-O-methyluridine-3'-phosphate
  modified_base 7: mod_base = OTHER; note = 2'-O-methylguanosine-3'-phosphate
  modified_base 8: mod_base = OTHER; note = 2'-O-methyluridine-3'-phosphate
  modified_base 9: mod_base = OTHER; note = 2'-O-methyluridine-3'-phosphate
  modified_base 10: mod_base = OTHER; note = 2'-O-methylcytidine-3'-phosphate
  modified_base 12: mod_base = OTHER; note = 2'-O-methyluridine-3'-phosphate
  modified_base 13: mod_base = OTHER; note = 2'-O-methylguanosine-3'-phosphate
  modified_base 14: mod_base = OTHER; note = 2'-O-methylcytidine-3'-phosphate
  modified_base 15: mod_base = OTHER; note = 2'-O-methyluridine-3'-phosphate
  modified_base 16: mod_base = OTHER; note = 2'-O-methylcytidine-3'-phosphate
  modified_base 17: mod_base = OTHER; note = Thymidine-glycol nucleic acid (GNA), S-Isomer
  modified_base 18: mod_base = OTHER; note = 2'-O-methyladenosine-3'-phosphate
  modified_base 19: mod_base = OTHER; note = 2'-O-methyluridine-3'-phosphate
  modified_base 20: mod_base = OTHER; note = 2'-O-methyladenosine-3'-phosphate
  modified_base 21: mod_base = OTHER; note = 2'-O-methyladenosine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
  misc_feature 1..10: note = RNA
  misc_feature 12..21: note = RNA
  misc_feature 11: note = DNA
aacagtgttcttgctctataa

SEQ ID NO: 95 - RNA, 21 nt, synthetic construct
  source 1..21: mol_type = other RNA
  modified_base 1: mod_base = OTHER; note = 2'-deoxy-2'-fluoroguanosine-3'-phosphorothioate
  modified_base 2: mod_base = OTHER; note = 2'-O-methylcytidine-3'-phosphorothioate
  modified_base 3: mod_base = OTHER; note = 2'-deoxy-2'-fluorouridine-3'-phosphate
  modified_base 4: mod_base = OTHER; note = 2'-O-methyluridine-3'-phosphate
  modified_base 5: mod_base = OTHER; note = 2'-deoxy-2'-fluoroadenosine-3'-phosphate
  modified_base 6: mod_base = OTHER; note = 2'-O-methyladenosine-3'-phosphate
  modified_base 7: mod_base = OTHER; note = 2'-deoxy-2'-fluoroadenosine-3'-phosphate
  modified_base 8: mod_base = OTHER; note = 2'-O-methyladenosine-3'-phosphate
  modified_base 9: mod_base = OTHER; note = 2'-deoxy-2'-fluoroguanosine-3'-phosphate
  modified_base 10: mod_base = OTHER; note = 2'-deoxy-2'-fluoroguanosine-3'-phosphate
  modified_base 11: mod_base = OTHER; note = 2'-deoxy-2'-fluoroguanosine-3'-phosphate
  modified_base 12: mod_base = OTHER; note = 2'-O-methyladenosine-3'-phosphate
  modified_base 13: mod_base = OTHER; note = 2'-deoxy-2'-fluorocytidine-3'-phosphate
  modified_base 14: mod_base = OTHER; note = 2'-O-methyladenosine-3'-phosphate
  modified_base 15: mod_base = OTHER; note = 2'-deoxy-2'-fluoroguanosine-3'-phosphate
  modified_base 16: mod_base = OTHER; note = 2'-O-methyluridine-3'-phosphate
  modified_base 17: mod_base = OTHER; note = 2'-deoxy-2'-fluoroadenosine-3'-phosphate
  modified_base 18: mod_base = OTHER; note = 2'-O-methyluridine-3'-phosphate
  modified_base 19: mod_base = OTHER; note = 2'-deoxy-2'-fluorouridine-3'-phosphate
  modified_base 20: mod_base = OTHER; note = 2'-O-methylcytidine-3'-phosphate
  modified_base 21: mod_base = OTHER; note = 2'-deoxy-2'-fluorouridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
gcttaaaagggacagtattct

SEQ ID NO: 96 - RNA, 21 nt, synthetic construct
  source 1..21: mol_type = other RNA
  modified_base 1: mod_base = OTHER; note = 2'-deoxy-2'-fluoroguanosine-3'-phosphorothioate
  modified_base 2: mod_base = OTHER; note = 2'-O-methylcytidine-3'-phosphorothioate
  modified_base 3: mod_base = OTHER; note = 2'-deoxy-2'-fluorouridine-3'-phosphate
  modified_base 4: mod_base = OTHER; note = 2'-O-methyluridine-3'-phosphate
  modified_base 5: mod_base = OTHER; note = 2'-deoxy-2'-fluoroadenosine-3'-phosphate
  modified_base 6: mod_base = OTHER; note = 2'-O-methyladenosine-3'-phosphate
  modified_base 7: mod_base = OTHER; note = 2'-deoxy-2'-fluoroadenosine-3'-phosphate
  modified_base 8: mod_base = OTHER; note = 2'-O-methyladenosine-3'-phosphate
  modified_base 9: mod_base = OTHER; note = 2'-deoxy-2'-fluoroguanosine-3'-phosphate
  modified_base 10: mod_base = OTHER; note = 2'-deoxy-2'-fluoroguanosine-3'-phosphate
  modified_base 11: mod_base = OTHER; note = 2'-deoxy-2'-fluoroguanosine-3'-phosphate
  modified_base 12: mod_base = OTHER; note = 2'-O-methyladenosine-3'-phosphate
  modified_base 13: mod_base = OTHER; note = 2'-deoxy-2'-fluorocytidine-3'-phosphate
  modified_base 14: mod_base = OTHER; note = 2'-O-methyladenosine-3'-phosphate
  modified_base 15: mod_base = OTHER; note = 2'-deoxy-2'-fluoroguanosine-3'-phosphate
  modified_base 16: mod_base = OTHER; note = 2'-O-methyluridine-3'-phosphate
  modified_base 17: mod_base = OTHER; note = 2'-deoxy-2'-fluoroadenosine-3'-phosphate
  modified_base 18: mod_base = OTHER; note = 2'-O-methyluridine-3'-phosphate
  modified_base 19: mod_base = OTHER; note = 2'-deoxy-2'-fluorouridine-3'-phosphate
  modified_base 20: mod_base = OTHER; note = 2'-O-methylcytidine-3'-phosphate
  modified_base 21: mod_base = OTHER; note = 2'-deoxy-2'-fluorouridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
gcttaaaagggacagtattct

SEQ ID NO: 97 - RNA, 21 nt, synthetic construct
  source 1..21: mol_type = other RNA
  modified_base 1: mod_base = OTHER; note = 2'-deoxy-2'-fluoroguanosine-3'-phosphorothioate
  modified_base 2: mod_base = OTHER; note = 2'-O-methylcytidine-3'-phosphorothioate
  modified_base 3: mod_base = OTHER; note = 2'-deoxy-2'-fluorouridine-3'-phosphate
  modified_base 4: mod_base = OTHER; note = 2'-O-methyluridine-3'-phosphate
  modified_base 5: mod_base = OTHER; note = 2'-deoxy-2'-fluoroadenosine-3'-phosphate
  modified_base 6: mod_base = OTHER; note = 2'-O-methyladenosine-3'-phosphate
  modified_base 7: mod_base = OTHER; note = 2'-deoxy-2'-fluoroadenosine-3'-phosphate
  modified_base 8: mod_base = OTHER; note = 2'-O-methyladenosine-3'-phosphate
  modified_base 9: mod_base = OTHER; note = 2'-deoxy-2'-fluoroguanosine-3'-phosphate
  modified_base 10: mod_base = OTHER; note = 2'-deoxy-2'-fluoroguanosine-3'-phosphate
  modified_base 11: mod_base = OTHER; note = 2'-deoxy-2'-fluoroguanosine-3'-phosphate
  modified_base 12: mod_base = OTHER; note = 2'-O-methyladenosine-3'-phosphate
  modified_base 13: mod_base = OTHER; note = 2'-deoxy-2'-fluorocytidine-3'-phosphate
  modified_base 14: mod_base = OTHER; note = 2'-O-methyladenosine-3'-phosphate
  modified_base 15: mod_base = OTHER; note = 2'-deoxy-2'-fluoroguanosine-3'-phosphate
  modified_base 16: mod_base = OTHER; note = 2'-O-methyluridine-3'-phosphate
  modified_base 17: mod_base = OTHER; note = 2'-deoxy-2'-fluoroadenosine-3'-phosphate
  modified_base 18: mod_base = OTHER; note = 2'-O-methyluridine-3'-phosphate
  modified_base 19: mod_base = OTHER; note = 2'-deoxy-2'-fluorouridine-3'-phosphate
  modified_base 20: mod_base = OTHER; note = 2'-O-methylcytidine-3'-phosphate
  modified_base 21: mod_base = OTHER; note = 2'-deoxy-2'-fluorouridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
gcttaaaagggacagtattct

SEQ ID NO: 98 - RNA, 21 nt, synthetic construct
  source 1..21: mol_type = other RNA
  modified_base 1: mod_base = OTHER; note = 2'-deoxy-2'-fluorouridine-3'-phosphorothioate
  modified_base 2: mod_base = OTHER; note = 2'-O-methylguanosine-3'-phosphorothioate
  modified_base 3: mod_base = OTHER; note = 2'-deoxy-2'-fluoroguanosine-3'-phosphate
  modified_base 4: mod_base = OTHER; note = 2'-O-methylguanosine-3'-phosphate
  modified_base 5: mod_base = OTHER; note = 2'-deoxy-2'-fluoroadenosine-3'-phosphate
  modified_base 6: mod_base = OTHER; note = 2'-O-methyluridine-3'-phosphate
  modified_base 7: mod_base = OTHER; note = 2'-deoxy-2'-fluorouridine-3'-phosphate
  modified_base 8: mod_base = OTHER; note = 2'-O-methyluridine-3'-phosphate
  modified_base 9: mod_base = OTHER; note = 2'-deoxy-2'-fluorocytidine-3'-phosphate
  modified_base 10: mod_base = OTHER; note = 2'-deoxy-2'-fluoroadenosine-3'-phosphate
  modified_base 11: mod_base = OTHER; note = 2'-deoxy-2'-fluorouridine-3'-phosphate
  modified_base 12: mod_base = OTHER; note = 2'-O-methylguanosine-3'-phosphate
  modified_base 13: mod_base = OTHER; note = 2'-deoxy-2'-fluorouridine-3'-phosphate
  modified_base 14: mod_base = OTHER; note = 2'-O-methyladenosine-3'-phosphate
  modified_base 15: mod_base = OTHER; note = 2'-deoxy-2'-fluoroadenosine-3'-phosphate
  modified_base 16: mod_base = OTHER; note = 2'-O-methylcytidine-3'-phosphate
  modified_base 17: mod_base = OTHER; note = 2'-deoxy-2'-fluorocytidine-3'-phosphate
  modified_base 18: mod_base = OTHER; note = 2'-O-methyladenosine-3'-phosphate
  modified_base 19: mod_base = OTHER; note = 2'-deoxy-2'-fluoroadenosine-3'-phosphate
  modified_base 20: mod_base = OTHER; note = 2'-O-methylguanosine-3'-phosphate
  modified_base 21: mod_base = OTHER; note = 2'-deoxy-2'-fluoroadenosine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
tgggatttcatgtaaccaaga

SEQ ID NO: 99 - RNA, 21 nt, synthetic construct
  source 1..21: mol_type = other RNA
  modified_base 1: mod_base = OTHER; note = 2'-deoxy-2'-fluorouridine-3'-phosphorothioate
  modified_base 2: mod_base = OTHER; note = 2'-O-methylguanosine-3'-phosphorothioate
  modified_base 3: mod_base = OTHER; note = 2'-deoxy-2'-fluoroguanosine-3'-phosphate
  modified_base 4: mod_base = OTHER; note = 2'-O-methylguanosine-3'-phosphate
  modified_base 5: mod_base = OTHER; note = 2'-deoxy-2'-fluoroadenosine-3'-phosphate
  modified_base 6: mod_base = OTHER; note = 2'-O-methyluridine-3'-phosphate
  modified_base 7: mod_base = OTHER; note = 2'-deoxy-2'-fluorouridine-3'-phosphate
  modified_base 8: mod_base = OTHER; note = 2'-O-methyluridine-3'-phosphate
  modified_base 9: mod_base = OTHER; note = 2'-deoxy-2'-fluorocytidine-3'-phosphate
  modified_base 10: mod_base = OTHER; note = 2'-deoxy-2'-fluoroadenosine-3'-phosphate
  modified_base 11: mod_base = OTHER; note = 2'-deoxy-2'-fluorouridine-3'-phosphate
  modified_base 12: mod_base = OTHER; note = 2'-O-methylguanosine-3'-phosphate
  modified_base 13: mod_base = OTHER; note = 2'-deoxy-2'-fluorouridine-3'-phosphate
  modified_base 14: mod_base = OTHER; note = 2'-O-methyladenosine-3'-phosphate
  modified_base 15: mod_base = OTHER; note = 2'-deoxy-2'-fluoroadenosine-3'-phosphate
  modified_base 16: mod_base = OTHER; note = 2'-O-methylcytidine-3'-phosphate
  modified_base 17: mod_base = OTHER; note = 2'-deoxy-2'-fluorocytidine-3'-phosphate
  modified_base 18: mod_base = OTHER; note = 2'-O-methyladenosine-3'-phosphate
  modified_base 19: mod_base = OTHER; note = 2'-deoxy-2'-fluoroadenosine-3'-phosphate
  modified_base 20: mod_base = OTHER; note = 2'-O-methylguanosine-3'-phosphate
  modified_base 21: mod_base = OTHER; note = 2'-deoxy-2'-fluoroadenosine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
tgggatttcatgtaaccaaga

SEQ ID NO: 100 - RNA, 21 nt, synthetic construct
  source 1..21: mol_type = other RNA
  modified_base 1: mod_base = OTHER; note = 2'-deoxy-2'-fluorouridine-3'-phosphorothioate
  modified_base 2: mod_base = OTHER; note = 2'-O-methylguanosine-3'-phosphorothioate
  modified_base 3: mod_base = OTHER; note = 2'-deoxy-2'-fluoroguanosine-3'-phosphate
  modified_base 4: mod_base = OTHER; note = 2'-O-methylguanosine-3'-phosphate
  modified_base 5: mod_base = OTHER; note = 2'-deoxy-2'-fluoroadenosine-3'-phosphate
  modified_base 6: mod_base = OTHER; note = 2'-O-methyluridine-3'-phosphate
  modified_base 7: mod_base = OTHER; note = 2'-deoxy-2'-fluorouridine-3'-phosphate
  modified_base 8: mod_base = OTHER; note = 2'-O-methyluridine-3'-phosphate
  modified_base 9: mod_base = OTHER; note = 2'-deoxy-2'-fluorocytidine-3'-phosphate
  modified_base 10: mod_base = OTHER; note = 2'-deoxy-2'-fluoroadenosine-3'-phosphate
  modified_base 11: mod_base = OTHER; note = 2'-deoxy-2'-fluorouridine-3'-phosphate
  modified_base 12: mod_base = OTHER; note = 2'-O-methylguanosine-3'-phosphate
  modified_base 13: mod_base = OTHER; note = 2'-deoxy-2'-fluorouridine-3'-phosphate
  modified_base 14: mod_base = OTHER; note = 2'-O-methyladenosine-3'-phosphate
  modified_base 15: mod_base = OTHER; note = 2'-deoxy-2'-fluoroadenosine-3'-phosphate
  modified_base 16: mod_base = OTHER; note = 2'-O-methylcytidine-3'-phosphate
  modified_base 17: mod_base = OTHER; note = 2'-deoxy-2'-fluorocytidine-3'-phosphate
  modified_base 18: mod_base = OTHER; note = 2'-O-methyladenosine-3'-phosphate
  modified_base 19: mod_base = OTHER; note = 2'-deoxy-2'-fluoroadenosine-3'-phosphate
  modified_base 20: mod_base = OTHER; note = 2'-O-methylguanosine-3'-phosphate
  modified_base 21: mod_base = OTHER; note = 2'-deoxy-2'-fluoroadenosine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
tgggatttcatgtaaccaaga

SEQ ID NO: 101 - RNA, 21 nt, synthetic construct
  source 1..21: mol_type = other RNA
  modified_base 1: mod_base = OTHER; note = 2'-deoxy-2'-fluorouridine-3'-phosphorothioate
  modified_base 2: mod_base = OTHER; note = 2'-O-methylguanosine-3'-phosphorothioate
  modified_base 3: mod_base = OTHER; note = 2'-deoxy-2'-fluoroguanosine-3'-phosphate
  modified_base 4: mod_base = OTHER; note = 2'-O-methylguanosine-3'-phosphate
  modified_base 5: mod_base = OTHER; note = 2'-deoxy-2'-fluoroadenosine-3'-phosphate
  modified_base 6: mod_base = OTHER; note = 2'-O-methyluridine-3'-phosphate
  modified_base 7: mod_base = OTHER; note = 2'-deoxy-2'-fluorouridine-3'-phosphate
  modified_base 8: mod_base = OTHER; note = 2'-O-methyluridine-3'-phosphate
  modified_base 9: mod_base = OTHER; note = 2'-deoxy-2'-fluorocytidine-3'-phosphate
  modified_base 10: mod_base = OTHER; note = 2'-deoxy-2'-fluoroadenosine-3'-phosphate
  modified_base 11: mod_base = OTHER; note = 2'-deoxy-2'-fluorouridine-3'-phosphate
  modified_base 12: mod_base = OTHER; note = 2'-O-methylguanosine-3'-phosphate
  modified_base 13: mod_base = OTHER; note = 2'-deoxy-2'-fluorouridine-3'-phosphate
  modified_base 14: mod_base = OTHER; note = 2'-O-methyladenosine-3'-phosphate
  modified_base 15: mod_base = OTHER; note = 2'-deoxy-2'-fluoroadenosine-3'-phosphate
  modified_base 16: mod_base = OTHER; note = 2'-O-methylcytidine-3'-phosphate
  modified_base 17: mod_base = OTHER; note = 2'-deoxy-2'-fluorocytidine-3'-phosphate
  modified_base 18: mod_base = OTHER; note = 2'-O-methyladenosine-3'-phosphate
  modified_base 19: mod_base = OTHER; note = 2'-deoxy-2'-fluoroadenosine-3'-phosphate
  modified_base 20: mod_base = OTHER; note = 2'-O-methylguanosine-3'-phosphate
  modified_base 21: mod_base = OTHER; note = 2'-deoxy-2'-fluoroadenosine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
tgggatttcatgtaaccaaga

SEQ ID NO: 102 - RNA, 21 nt, synthetic construct
  source 1..21: mol_type = other RNA
  modified_base 1: mod_base = OTHER; note = 2'-deoxy-2'-fluorocytidine-3'-phosphorothioate
  modified_base 2: mod_base = OTHER; note = 2'-O-methyluridine-3'-phosphorothioate
  modified_base 3: mod_base = OTHER; note = 2'-deoxy-2'-fluoroguanosine-3'-phosphate
  modified_base 4: mod_base = OTHER; note = 2'-O-methylguanosine-3'-phosphate
  modified_base 5: mod_base = OTHER; note = 2'-deoxy-2'-fluorouridine-3'-phosphate
  modified_base 6: mod_base = OTHER; note = 2'-O-methyladenosine-3'-phosphate
  modified_base 7: mod_base = OTHER; note = 2'-deoxy-2'-fluorouridine-3'-phosphate
  modified_base 8: mod_base = OTHER; note = 2'-O-methyluridine-3'-phosphate
  modified_base 9: mod_base = OTHER; note = 2'-deoxy-2'-fluorouridine-3'-phosphate
  modified_base 10: mod_base = OTHER; note = 2'-deoxy-2'-fluorocytidine-3'-phosphate
  modified_base 11: mod_base = OTHER; note = 2'-deoxy-2'-fluorocytidine-3'-phosphate
  modified_base 12: mod_base = OTHER; note = 2'-O-methyluridine-3'-phosphate
  modified_base 13: mod_base = OTHER; note = 2'-deoxy-2'-fluoroadenosine-3'-phosphate
  modified_base 14: mod_base = OTHER; note = 2'-O-methylguanosine-3'-phosphate
  modified_base 15: mod_base = OTHER; note = 2'-deoxy-2'-fluoroguanosine-3'-phosphate
  modified_base 16: mod_base = OTHER; note = 2'-O-methylguanosine-3'-phosphate
  modified_base 17: mod_base = OTHER; note = 2'-deoxy-2'-fluorouridine-3'-phosphate
  modified_base 18: mod_base = OTHER; note = 2'-O-methyladenosine-3'-phosphate
  modified_base 19: mod_base = OTHER; note = 2'-deoxy-2'-fluorocytidine-3'-phosphate
  modified_base 20: mod_base = OTHER; note = 2'-O-methyladenosine-3'-phosphate
  modified_base 21: mod_base = OTHER; note = 2'-deoxy-2'-fluoroadenosine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
ctggtatttcctagggtacaa

SEQ ID NO: 103 - DNA, 21 bp, synthetic construct
  source 1..21: mol_type = other DNA
  modified_base 1: mod_base = OTHER; note = 2'-O-methylcytidine-3'-phosphorothioate
  modified_base 2: mod_base = OTHER; note = 2'-O-methyluridine-3'-phosphorothioate
  modified_base 3: mod_base = OTHER; note = 2'-O-methylguanosine-3'-phosphate
  modified_base 4: mod_base = OTHER; note = 2'-O-methylguanosine-3'-phosphate
  modified_base 5: mod_base = OTHER; note = 2'-O-methyluridine-3'-phosphate
  modified_base 6: mod_base = OTHER; note = 2'-O-methyladenosine-3'-phosphate
  modified_base 7: mod_base = OTHER; note = 2'-O-methyluridine-3'-phosphate
  modified_base 8: mod_base = OTHER; note = 2'-O-methyluridine-3'-phosphate
  modified_base 9: mod_base = OTHER; note = 2'-O-methyluridine-3'-phosphate
  modified_base 10: mod_base = OTHER; note = 2'-O-methylcytidine-3'-phosphate
  modified_base 12: mod_base = OTHER; note = 2'-O-methyluridine-3'-phosphate
  modified_base 13: mod_base = OTHER; note = 2'-O-methyladenosine-3'-phosphate
  modified_base 14: mod_base = OTHER; note = 2'-O-methylguanosine-3'-phosphate
  modified_base 15: mod_base = OTHER; note = 2'-O-methylguanosine-3'-phosphate
  modified_base 16: mod_base = OTHER; note = 2'-O-methylguanosine-3'-phosphate
  modified_base 17: mod_base = OTHER; note = Thymidine-glycol nucleic acid (GNA), S-Isomer
  modified_base 18: mod_base = OTHER; note = 2'-O-methyladenosine-3'-phosphate
  modified_base 19: mod_base = OTHER; note = 2'-O-methylcytidine-3'-phosphate
  modified_base 20: mod_base = OTHER; note = 2'-O-methyladenosine-3'-phosphate
  modified_base 21: mod_base = OTHER; note = 2'-O-methyladenosine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
  misc_feature 1..10: note = RNA
  misc_feature 12..21: note = RNA
  misc_feature 11: note = DNA
ctggtatttcctagggtacaa

SEQ ID NO: 104 - DNA, 21 bp, synthetic construct
  source 1..21: mol_type = other DNA
  modified_base 1: mod_base = OTHER; note = 2'-O-methylcytidine-3'-phosphorothioate
  modified_base 2: mod_base = OTHER; note = 2'-O-methyluridine-3'-phosphorothioate
  modified_base 3: mod_base = OTHER; note = 2'-O-methylguanosine-3'-phosphate
  modified_base 4: mod_base = OTHER; note = 2'-O-methylguanosine-3'-phosphate
  modified_base 5: mod_base = OTHER; note = 2'-O-methyluridine-3'-phosphate
  modified_base 6: mod_base = OTHER; note = 2'-O-methyladenosine-3'-phosphate
  modified_base 7: mod_base = OTHER; note = 2'-O-methyluridine-3'-phosphate
  modified_base 8: mod_base = OTHER; note = 2'-O-methyluridine-3'-phosphate
  modified_base 9: mod_base = OTHER; note = 2'-O-methyluridine-3'-phosphate
  modified_base 10: mod_base = OTHER; note = 2'-O-methylcytidine-3'-phosphate
  modified_base 12: mod_base = OTHER; note = 2'-O-methyluridine-3'-phosphate
  modified_base 13: mod_base = OTHER; note = 2'-O-methyladenosine-3'-phosphate
  modified_base 14: mod_base = OTHER; note = 2'-O-methylguanosine-3'-phosphate
  modified_base 15: mod_base = OTHER; note = 2'-O-methylguanosine-3'-phosphate
  modified_base 16: mod_base = OTHER; note = 2'-O-methylguanosine-3'-phosphate
  modified_base 17: mod_base = OTHER; note = Thymidine-glycol nucleic acid (GNA), S-Isomer
  modified_base 18: mod_base = OTHER; note = 2'-O-methyladenosine-3'-phosphate
  modified_base 19: mod_base = OTHER; note = 2'-O-methylcytidine-3'-phosphate
  modified_base 20: mod_base = OTHER; note = 2'-O-methyladenosine-3'-phosphate
  modified_base 21: mod_base = OTHER; note = 2'-O-methyladenosine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
  misc_feature 1..10: note = RNA
  misc_feature 12..21: note = RNA
  misc_feature 11: note = DNA
ctggtatttcctagggtacaa

SEQ ID NO: 105 - RNA, 23 nt, synthetic construct
  source 1..23: mol_type = other RNA
  modified_base 1: mod_base = OTHER; note = 2'-O-methyluridine-3'-phosphorothioate
  modified_base 2: mod_base = OTHER; note = 2'-deoxy-2'-fluorouridine-3'-phosphorothioate
  modified_base 3: mod_base = OTHER; note = 2'-O-methyladenosine-3'-phosphate
  modified_base 4: mod_base = OTHER; note = 2'-deoxy-2'-fluorouridine-3'-phosphate
  modified_base 5: mod_base = OTHER; note = 2'-O-methyladenosine-3'-phosphate
  modified_base 6: mod_base = OTHER; note = 2'-deoxy-2'-fluoroguanosine-3'-phosphate
  modified_base 7: mod_base = OTHER; note = 2'-O-methyladenosine-3'-phosphate
  modified_base 8: mod_base = OTHER; note = 2'-deoxy-2'-fluoroguanosine-3'-phosphate
  modified_base 9: mod_base = OTHER; note = 2'-O-methylcytidine-3'-phosphate
  modified_base 10: mod_base = OTHER; note = 2'-deoxy-2'-fluoroadenosine-3'-phosphate
  modified_base 11: mod_base = OTHER; note = 2'-O-methyladenosine-3'-phosphate
  modified_base 12: mod_base = OTHER; note = 2'-O-methylguanosine-3'-phosphate
  modified_base 13: mod_base = OTHER; note = 2'-O-methyladenosine-3'-phosphate
  modified_base 14: mod_base = OTHER; note = 2'-deoxy-2'-fluoroadenosine-3'-phosphate
  modified_base 15: mod_base = OTHER; note = 2'-O-methylcytidine-3'-phosphate
  modified_base 16: mod_base = OTHER; note = 2'-deoxy-2'-fluoroadenosine-3'-phosphate
  modified_base 17: mod_base = OTHER; note = 2'-O-methylcytidine-3'-phosphate
  modified_base 18: mod_base = OTHER; note = 2'-deoxy-2'-fluorouridine-3'-phosphate
  modified_base 19: mod_base = OTHER; note = 2'-O-methylguanosine-3'-phosphate
  modified_base 20: mod_base = OTHER; note = 2'-deoxy-2'-fluorouridine-3'-phosphate
  modified_base 21: mod_base = OTHER; note = 2'-O-methyluridine-3'-phosphorothioate
  modified_base 22: mod_base = OTHER; note = 2'-O-methyluridine-3'-phosphorothioate
  modified_base 23: mod_base = OTHER; note = 2'-O-methyluridine
ttatagagcaagaacactgtttt

SEQ ID NO: 106 - DNA, 23 bp, synthetic construct
  source 1..23: mol_type = other DNA
  modified_base 1: mod_base = OTHER; note = 2'-O-methyluridine-3'-phosphorothioate
  modified_base 2: mod_base = OTHER; note = 2'-deoxythymidine-3'-phosphorothioate
  modified_base 3: mod_base = OTHER; note = 2'-O-methyladenosine-3'-phosphate
  modified_base 4: mod_base = OTHER; note = 2'-O-methyluridine-3'-phosphate
  modified_base 5: mod_base = OTHER; note = 2'-O-methyladenosine-3'-phosphate
  modified_base 6: mod_base = OTHER; note = 2'-O-methylguanosine-3'-phosphate
  modified_base 7: mod_base = OTHER; note = 2'-O-methyladenosine-3'-phosphate
  modified_base 8: mod_base = OTHER; note = 2'-O-methylguanosine-3'-phosphate
  modified_base 9: mod_base = OTHER; note = 2'-O-methylcytidine-3'-phosphate
  modified_base 11: mod_base = OTHER; note = 2'-O-methyladenosine-3'-phosphate
  modified_base 12: mod_base = OTHER; note = 2'-O-methylguanosine-3'-phosphate
  modified_base 13: mod_base = OTHER; note = 2'-O-methyladenosine-3'-phosphate
  modified_base 15: mod_base = OTHER; note = 2'-O-methylcytidine-3'-phosphate
  modified_base 16: mod_base = OTHER; note = 2'-O-methyladenosine-3'-phosphate
  modified_base 17: mod_base = OTHER; note = 2'-O-methylcytidine-3'-phosphate
  modified_base 18: mod_base = OTHER; note = 2'-O-methyluridine-3'-phosphate
  modified_base 19: mod_base = OTHER; note = 2'-O-methylguanosine-3'-phosphate
  modified_base 20: mod_base = OTHER; note = 2'-O-methyluridine-3'-phosphate
  modified_base 21: mod_base = OTHER; note = 2'-O-methyluridine-3'-phosphorothioate
  modified_base 22: mod_base = OTHER; note = 2'-O-methyluridine-3'-phosphorothioate
  modified_base 23: mod_base = OTHER; note = 2'-O-methyluridine
  misc_feature 1: note = RNA
  misc_feature 3..9: note = RNA
  misc_feature 11..13: note = RNA
  misc_feature 15..23: note = RNA
  misc_feature 2: note = DNA
  misc_feature 10: note = DNA
  misc_feature 14: note = DNA
ttatagagcaagaacactgtttt

SEQ ID NO: 107 - DNA, 23 bp, synthetic construct
  source 1..23: mol_type = other DNA
  modified_base 1: mod_base = OTHER; note = 2'-O-methyluridine-3'-phosphorothioate
  modified_base 2: mod_base = OTHER; note = 2'-O-methyluridine-3'-phosphorothioate
  modified_base 3: mod_base = OTHER; note = 2'-O-methyladenosine-3'-phosphate
  modified_base 4: mod_base = OTHER; note = 2'-O-methyluridine-3'-phosphate
  modified_base 5: mod_base = OTHER; note = 2'-O-methyladenosine-3'-phosphate
  modified_base 6: mod_base = OTHER; note = 2'-O-methylguanosine-3'-phosphate
  modified_base 7: mod_base = OTHER; note = 2'-O-methyladenosine-3'-phosphate
  modified_base 8: mod_base = OTHER; note = 2'-O-methylguanosine-3'-phosphate
  modified_base 9: mod_base = OTHER; note = 2'-O-methylcytidine-3'-phosphate
  modified_base 11: mod_base = OTHER; note = 2'-O-methyladenosine-3'-phosphate
  modified_base 12: mod_base = OTHER; note = 2'-O-methylguanosine-3'-phosphate
  modified_base 13: mod_base = OTHER; note = 2'-O-methyladenosine-3'-phosphate
  modified_base 15: mod_base = OTHER; note = 2'-O-methylcytidine-3'-phosphate
  modified_base 16: mod_base = OTHER; note = 2'-O-methyladenosine-3'-phosphate
  modified_base 17: mod_base = OTHER; note = 2'-O-methylcytidine-3'-phosphate
  modified_base 18: mod_base = OTHER; note = 2'-O-methyluridine-3'-phosphate
  modified_base 19: mod_base = OTHER; note = 2'-O-methylguanosine-3'-phosphate
  modified_base 20: mod_base = OTHER; note = 2'-O-methyluridine-3'-phosphate
  modified_base 21: mod_base = OTHER; note = 2'-O-methyluridine-3'-phosphorothioate
  modified_base 22: mod_base = OTHER; note = 2'-O-methyluridine-3'-phosphorothioate
  modified_base 23: mod_base = OTHER; note = 2'-O-methyluridine
  misc_feature 1..9: note = RNA
  misc_feature 11..13: note = RNA
  misc_feature 15..23: note = RNA
  misc_feature 10: note = DNA
  misc_feature 14: note = DNA
ttatagagcaagaacactgtttt

SEQ ID NO: 108 - DNA, 23 bp, synthetic construct
  source 1..23: mol_type = other DNA
  modified_base 1: mod_base = OTHER; note = 2'-O-methyluridine-3'-phosphorothioate
  modified_base 2: mod_base = OTHER; note = uridine-3'-phosphorothioate
  modified_base 3: mod_base = OTHER; note = 2'-O-methyladenosine-3'-phosphate
  modified_base 4: mod_base = OTHER; note = 2'-O-methyluridine-3'-phosphate
  modified_base 5: mod_base = OTHER; note = 2'-O-methyladenosine-3'-phosphate
  modified_base 6: mod_base = OTHER; note = 2'-O-methylguanosine-3'-phosphate
  modified_base 7: mod_base = OTHER; note = 2'-O-methyladenosine-3'-phosphate
  modified_base 8: mod_base = OTHER; note = 2'-O-methylguanosine-3'-phosphate
  modified_base 9: mod_base = OTHER; note = 2'-O-methylcytidine-3'-phosphate
  modified_base 11: mod_base = OTHER; note = 2'-O-methyladenosine-3'-phosphate
  modified_base 12: mod_base = OTHER; note = 2'-O-methylguanosine-3'-phosphate
  modified_base 13: mod_base = OTHER; note = 2'-O-methyladenosine-3'-phosphate
  modified_base 15: mod_base = OTHER; note = 2'-O-methylcytidine-3'-phosphate
  modified_base 16: mod_base = OTHER; note = 2'-O-methyladenosine-3'-phosphate
  modified_base 17: mod_base = OTHER; note = 2'-O-methylcytidine-3'-phosphate
  modified_base 18: mod_base = OTHER; note = 2'-O-methyluridine-3'-phosphate
  modified_base 19: mod_base = OTHER; note = 2'-O-methylguanosine-3'-phosphate
  modified_base 20: mod_base = OTHER; note = 2'-O-methyluridine-3'-phosphate
  modified_base 21: mod_base = OTHER; note = 2'-O-methyluridine-3'-phosphorothioate
  modified_base 22: mod_base = OTHER; note = 2'-O-methyluridine-3'-phosphorothioate
  modified_base 23: mod_base = OTHER; note = 2'-O-methyluridine
  misc_feature 1..9: note = RNA
  misc_feature 11..13: note = RNA
  misc_feature 15..23: note = RNA
  misc_feature 10: note = DNA
  misc_feature 14: note = DNA
ttatagagcaagaacactgtttt

SEQ ID NO: 109 - RNA, 23 nt, synthetic construct
  source 1..23: mol_type = other RNA
  modified_base 1: mod_base = OTHER; note = 2'-O-methyladenosine-3'-phosphorothioate
  modified_base 2: mod_base = OTHER; note = 2'-deoxy-2'-fluoroguanosine-3'-phosphorothioate
  modified_base 3: mod_base = OTHER; note = 2'-O-methyladenosine-3'-phosphate
  modified_base 4: mod_base = OTHER; note = 2'-deoxy-2'-fluoroadenosine-3'-phosphate
  modified_base 5: mod_base = OTHER; note = 2'-O-methyluridine-3'-phosphate
  modified_base 6: mod_base = OTHER; note = 2'-deoxy-2'-fluoroadenosine-3'-phosphate
  modified_base 7: mod_base = OTHER; note = 2'-O-methylcytidine-3'-phosphate
  modified_base 8: mod_base = OTHER; note = 2'-deoxy-2'-fluorouridine-3'-phosphate
  modified_base 9: mod_base = OTHER; note = 2'-O-methylguanosine-3'-phosphate
  modified_base 10: mod_base = OTHER; note = 2'-deoxy-2'-fluorouridine-3'-phosphate
  modified_base 11: mod_base = OTHER; note = 2'-O-methylcytidine-3'-phosphate
  modified_base 12: mod_base = OTHER; note = 2'-O-methylcytidine-3'-phosphate
  modified_base 13: mod_base = OTHER; note = 2'-O-methylcytidine-3'-phosphate
  modified_base 14: mod_base = OTHER; note = 2'-deoxy-2'-fluorouridine-3'-phosphate
  modified_base 15: mod_base = OTHER; note = 2'-O-methyluridine-3'-phosphate
  modified_base 16: mod_base = OTHER; note = 2'-deoxy-2'-fluorouridine-3'-phosphate
  modified_base 17: mod_base = OTHER; note = 2'-O-methyluridine-3'-phosphate
  modified_base 18: mod_base = OTHER; note = 2'-deoxy-2'-fluoroadenosine-3'-phosphate
  modified_base 19: mod_base = OTHER; note = 2'-O-methyladenosine-3'-phosphate
  modified_base 20: mod_base = OTHER; note = 2'-deoxy-2'-fluoroguanosine-3'-phosphate
  modified_base 21: mod_base = OTHER; note = 2'-O-methylcytidine-3'-phosphorothioate
  modified_base 22: mod_base = OTHER; note = 2'-O-methyladenosine-3'-phosphorothioate
  modified_base 23: mod_base = OTHER; note = 2'-O-methyladenosine
agaatactgtcccttttaagcaa

SEQ ID NO: 110 - DNA, 23 bp, synthetic construct
  source 1..23: mol_type = other DNA
  modified_base 1: mod_base = OTHER; note = 2'-O-methyladenosine-3'-phosphorothioate
  modified_base 2: mod_base = OTHER; note = 2'-deoxyguanosine-3'-phosphorothioate
  modified_base 3: mod_base = OTHER; note = 2'-O-methyladenosine-3'-phosphate
  modified_base 4: mod_base = OTHER; note = 2'-O-methyladenosine-3'-phosphate
  modified_base 5: mod_base = OTHER; note = 2'-O-methyluridine-3'-phosphate
  modified_base 6: mod_base = OTHER; note = 2'-O-methyladenosine-3'-phosphate
  modified_base 7: mod_base = OTHER; note = 2'-O-methylcytidine-3'-phosphate
  modified_base 8: mod_base = OTHER; note = 2'-O-methyluridine-3'-phosphate
  modified_base 9: mod_base = OTHER; note = 2'-O-methylguanosine-3'-phosphate
  modified_base 11: mod_base = OTHER; note = 2'-O-methylcytidine-3'-phosphate
  modified_base 12: mod_base = OTHER; note = 2'-O-methylcytidine-3'-phosphate
  modified_base 13: mod_base = OTHER; note = 2'-O-methylcytidine-3'-phosphate
  modified_base 15: mod_base = OTHER; note = 2'-O-methyluridine-3'-phosphate
  modified_base 16: mod_base = OTHER; note = 2'-O-methyluridine-3'-phosphate
  modified_base 17: mod_base = OTHER; note = 2'-O-methyluridine-3'-phosphate
  modified_base 18: mod_base = OTHER; note = 2'-O-methyladenosine-3'-phosphate
  modified_base 19: mod_base = OTHER; note = 2'-O-methyladenosine-3'-phosphate
  modified_base 20: mod_base = OTHER; note = 2'-O-methylguanosine-3'-phosphate
  modified_base 21: mod_base = OTHER; note = 2'-O-methylcytidine-3'-phosphorothioate
  modified_base 22: mod_base = OTHER; note = 2'-O-methyladenosine-3'-phosphorothioate
  modified_base 23: mod_base = OTHER; note = 2'-O-methyladenosine
  misc_feature 1: note = RNA
  misc_feature 3..9: note = RNA
  misc_feature 11..13: note = RNA
  misc_feature 15..23: note = RNA
  misc_feature 2: note = DNA
  misc_feature 10: note = DNA
  misc_feature 14: note = DNA
agaatactgtcccttttaagcaa

SEQ ID NO: 111 - DNA, 23 bp, synthetic construct
  source 1..23: mol_type = other DNA
  modified_base 1: mod_base = OTHER; note = 2'-O-methyladenosine-3'-phosphorothioate
  modified_base 2: mod_base = OTHER; note = 2'-O-methylguanosine-3'-phosphorothioate
  modified_base 3: mod_base = OTHER; note = 2'-O-methyladenosine-3'-phosphate
  modified_base 4: mod_base = OTHER; note = 2'-O-methyladenosine-3'-phosphate
  modified_base 5: mod_base = OTHER; note = 2'-O-methyluridine-3'-phosphate
  modified_base 6: mod_base = OTHER; note = 2'-O-methyladenosine-3'-phosphate
  modified_base 7: mod_base = OTHER; note = 2'-O-methylcytidine-3'-phosphate
  modified_base 8: mod_base = OTHER; note = 2'-O-methyluridine-3'-phosphate
  modified_base 9: mod_base = OTHER; note = 2'-O-methylguanosine-3'-phosphate
  modified_base 11: mod_base = OTHER; note = 2'-O-methylcytidine-3'-phosphate
  modified_base 12: mod_base = OTHER; note = 2'-O-methylcytidine-3'-phosphate
  modified_base 13: mod_base = OTHER; note = 2'-O-methylcytidine-3'-phosphate
  modified_base 15: mod_base = OTHER; note = 2'-O-methyluridine-3'-phosphate
  modified_base 16: mod_base = OTHER; note = 2'-O-methyluridine-3'-phosphate
  modified_base 17: mod_base = OTHER; note = 2'-O-methyluridine-3'-phosphate
  modified_base 18: mod_base = OTHER; note = 2'-O-methyladenosine-3'-phosphate
  modified_base 19: mod_base = OTHER; note = 2'-O-methyladenosine-3'-phosphate
  modified_base 20: mod_base = OTHER; note = 2'-O-methylguanosine-3'-phosphate
  modified_base 21: mod_base = OTHER; note = 2'-O-methylcytidine-3'-phosphorothioate
  modified_base 22: mod_base = OTHER; note = 2'-O-methyladenosine-3'-phosphorothioate
  modified_base 23: mod_base = OTHER; note = 2'-O-methyladenosine
  misc_feature 1..9: note = RNA
  misc_feature 11..13: note = RNA
  misc_feature 15..23: note = RNA
  misc_feature 10: note = DNA
  misc_feature 14: note = DNA
agaatactgtcccttttaagcaa

SEQ ID NO: 112 - RNA, 23 nt, synthetic construct
  source 1..23: mol_type = other RNA
  modified_base 1: mod_base = OTHER; note = 2'-O-methyluridine-3'-phosphorothioate
  modified_base 2: mod_base = OTHER; note = 2'-deoxy-2'-fluorocytidine-3'-phosphorothioate
  modified_base 3: mod_base = OTHER; note = 2'-O-methyluridine-3'-phosphate
  modified_base 4: mod_base = OTHER; note = 2'-deoxy-2'-fluorouridine-3'-phosphate
  modified_base 5: mod_base = OTHER; note = 2'-O-methylguanosine-3'-phosphate
  modified_base 6: mod_base = OTHER; note = 2'-deoxy-2'-fluoroguanosine-3'-phosphate
  modified_base 7: mod_base = OTHER; note = 2'-O-methyluridine-3'-phosphate
  modified_base 8: mod_base = OTHER; note = 2'-deoxy-2'-fluorouridine-3'-phosphate
  modified_base 9: mod_base = OTHER; note = 2'-O-methyladenosine-3'-phosphate
  modified_base 10: mod_base = OTHER; note = 2'-deoxy-2'-fluorocytidine-3'-phosphate
  modified_base 11: mod_base = OTHER; note = 2'-O-methyladenosine-3'-phosphate
  modified_base 12: mod_base = OTHER; note = 2'-O-methyluridine-3'-phosphate
  modified_base 13: mod_base = OTHER; note = 2'-O-methylguanosine-3'-phosphate
  modified_base 14: mod_base = OTHER; note = 2'-deoxy-2'-fluoroadenosine-3'-phosphate
  modified_base 15: mod_base = OTHER; note = 2'-O-methyladenosine-3'-phosphate
  modified_base 16: mod_base = OTHER; note = 2'-deoxy-2'-fluoroadenosine-3'-phosphate
  modified_base 17: mod_base = OTHER; note = 2'-O-methyluridine-3'-phosphate
  modified_base 18: mod_base = OTHER; note = 2'-deoxy-2'-fluorocytidine-3'-phosphate
  modified_base 19: mod_base = OTHER; note = 2'-O-methylcytidine-3'-phosphate
  modified_base 20: mod_base = OTHER; note = 2'-deoxy-2'-fluorocytidine-3'-phosphate
  modified_base 21: mod_base = OTHER; note = 2'-O-methyladenosine-3'-phosphorothioate
  modified_base 22: mod_base = OTHER; note = 2'-O-methyluridine-3'-phosphorothioate
  modified_base 23: mod_base = OTHER; note = 2'-O-methylcytidine
tcttggttacatgaaatcccatc

SEQ ID NO: 113 - DNA, 23 bp, synthetic construct
  source 1..23: mol_type = other DNA
  modified_base 1: mod_base = OTHER; note = 2'-O-methyluridine-3'-phosphorothioate
  modified_base 2: mod_base = OTHER; note = 2'-deoxycytidine-3'-phosphorothioate
  modified_base 3: mod_base = OTHER; note = 2'-O-methyluridine-3'-phosphate
  modified_base 4: mod_base = OTHER; note = 2'-O-methyluridine-3'-phosphate
  modified_base 5: mod_base = OTHER; note = 2'-O-methylguanosine-3'-phosphate
  modified_base 6: mod_base = OTHER; note = 2'-O-methylguanosine-3'-phosphate
  modified_base 7: mod_base = OTHER; note = 2'-O-methyluridine-3'-phosphate
  modified_base 8: mod_base = OTHER; note = 2'-O-methyluridine-3'-phosphate
  modified_base 9: mod_base = OTHER; note = 2'-O-methyladenosine-3'-phosphate
  modified_base 11: mod_base = OTHER; note = 2'-O-methyladenosine-3'-phosphate
  modified_base 12: mod_base = OTHER; note = 2'-O-methyluridine-3'-phosphate
  modified_base 13: mod_base = OTHER; note = 2'-O-methylguanosine-3'-phosphate
  modified_base 15: mod_base = OTHER; note = 2'-O-methyladenosine-3'-phosphate
  modified_base 16: mod_base = OTHER; note = 2'-O-methyladenosine-3'-phosphate
  modified_base 17: mod_base = OTHER; note = 2'-O-methyluridine-3'-phosphate
  modified_base 18: mod_base = OTHER; note = 2'-O-methylcytidine-3'-phosphate
  modified_base 19: mod_base = OTHER; note = 2'-O-methylcytidine-3'-phosphate
  modified_base 20: mod_base = OTHER; note = 2'-O-methylcytidine-3'-phosphate
  modified_base 21: mod_base = OTHER; note = 2'-O-methyladenosine-3'-phosphorothioate
  modified_base 22: mod_base = OTHER; note = 2'-O-methyluridine-3'-phosphorothioate
  modified_base 23: mod_base = OTHER; note = 2'-O-methylcytidine
  misc_feature 1: note = RNA
  misc_feature 3..9: note = RNA
  misc_feature 11..13: note = RNA
  misc_feature 15..23: note = RNA
  misc_feature 2: note = DNA
  misc_feature 10: note = DNA
  misc_feature 14: note = DNA
tcttggttacatgaaatcccatc

SEQ ID NO: 114 - DNA, 23 bp, synthetic construct
  source 1..23: mol_type = other DNA
  modified_base 1: mod_base = OTHER; note = 2'-O-methyluridine-3'-phosphorothioate
  modified_base 2: mod_base = OTHER; note = 2'-O-methylcytidine-3'-phosphorothioate
  modified_base 3: mod_base = OTHER; note = 2'-O-methyluridine-3'-phosphate
  modified_base 4: mod_base = OTHER; note = 2'-O-methyluridine-3'-phosphate
  modified_base 5: mod_base = OTHER; note = 2'-O-methylguanosine-3'-phosphate
  modified_base 6: mod_base = OTHER; note = 2'-O-methylguanosine-3'-phosphate
  modified_base 7: mod_base = OTHER; note = 2'-O-methyluridine-3'-phosphate
  modified_base 8: mod_base = OTHER; note = 2'-O-methyluridine-3'-phosphate
  modified_base 9: mod_base = OTHER; note = 2'-O-methyladenosine-3'-phosphate
  modified_base 11: mod_base = OTHER; note = 2'-O-methyladenosine-3'-phosphate
  modified_base 12: mod_base = OTHER; note = 2'-O-methyluridine-3'-phosphate
  modified_base 13: mod_base = OTHER; note = 2'-O-methylguanosine-3'-phosphate
  modified_base 15: mod_base = OTHER; note = 2'-O-methyladenosine-3'-phosphate
  modified_base 16: mod_base = OTHER; note = 2'-O-methyladenosine-3'-phosphate
  modified_base 17: mod_base = OTHER; note = 2'-O-methyluridine-3'-phosphate
  modified_base 18: mod_base = OTHER; note = 2'-O-methylcytidine-3'-phosphate
  modified_base 19: mod_base = OTHER; note = 2'-O-methylcytidine-3'-phosphate
  modified_base 20: mod_base = OTHER; note = 2'-O-methylcytidine-3'-phosphate
  modified_base 21: mod_base = OTHER; note = 2'-O-methyladenosine-3'-phosphorothioate
  modified_base 22: mod_base = OTHER; note = 2'-O-methyluridine-3'-phosphorothioate
  modified_base 23: mod_base = OTHER; note = 2'-O-methylcytidine
  misc_feature 1..9: note = RNA
  misc_feature 11..13: note = RNA
  misc_feature 15..23: note = RNA
  misc_feature 10: note = DNA
  misc_feature 14: note = DNA
tcttggttacatgaaatcccatc

SEQ ID NO: 115 - DNA, 23 bp, synthetic construct
  source 1..23: mol_type = other DNA
  modified_base 1: mod_base = OTHER; note = 2'-O-methyluridine-3'-phosphorothioate
  modified_base 2: mod_base = OTHER; note = cytidine-3'-phosphorothioate
  modified_base 3: mod_base = OTHER; note = 2'-O-methyluridine-3'-phosphate
  modified_base 4: mod_base = OTHER; note = 2'-O-methyluridine-3'-phosphate
  modified_base 5: mod_base = OTHER; note = 2'-O-methylguanosine-3'-phosphate
  modified_base 6: mod_base = OTHER; note = 2'-O-methylguanosine-3'-phosphate
  modified_base 7: mod_base = OTHER; note = 2'-O-methyluridine-3'-phosphate
  modified_base 8: mod_base = OTHER; note = 2'-O-methyluridine-3'-phosphate
  modified_base 9: mod_base = OTHER; note = 2'-O-methyladenosine-3'-phosphate
  modified_base 11: mod_base = OTHER; note = 2'-O-methyladenosine-3'-phosphate
  modified_base 12: mod_base = OTHER; note = 2'-O-methyluridine-3'-phosphate
  modified_base 13: mod_base = OTHER; note = 2'-O-methylguanosine-3'-phosphate
  modified_base 15: mod_base = OTHER; note = 2'-O-methyladenosine-3'-phosphate
  modified_base 16: mod_base = OTHER; note = 2'-O-methyladenosine-3'-phosphate
  modified_base 17: mod_base = OTHER; note = 2'-O-methyluridine-3'-phosphate
  modified_base 18: mod_base = OTHER; note = 2'-O-methylcytidine-3'-phosphate
  modified_base 19: mod_base = OTHER; note = 2'-O-methylcytidine-3'-phosphate
  modified_base 20: mod_base = OTHER; note = 2'-O-methylcytidine-3'-phosphate
  modified_base 21: mod_base = OTHER; note = 2'-O-methyladenosine-3'-phosphorothioate
  modified_base 22: mod_base = OTHER; note = 2'-O-methyluridine-3'-phosphorothioate
  modified_base 23: mod_base = OTHER; note = 2'-O-methylcytidine
  misc_feature 1..9: note = RNA
  misc_feature 11..13: note = RNA
  misc_feature 15..23: note = RNA
  misc_feature 10: note = DNA
  misc_feature 14: note = DNA
tcttggttacatgaaatcccatc

SEQ ID NO: 116 - RNA, 23 nt, synthetic construct
  source 1..23: mol_type = other RNA
  modified_base 1: mod_base = OTHER; note = 2'-O-methyluridine-3'-phosphorothioate
  modified_base 2: mod_base = OTHER; note = 2'-deoxy-2'-fluorouridine-3'-phosphorothioate
  modified_base 3: mod_base = OTHER; note = 2'-O-methylguanosine-3'-phosphate
  modified_base 4: mod_base = OTHER; note = 2'-deoxy-2'-fluorouridine-3'-phosphate
  modified_base 5: mod_base = OTHER; note = 2'-O-methyladenosine-3'-phosphate
  modified_base 6: mod_base = OTHER; note = 2'-deoxy-2'-fluorocytidine-3'-phosphate
  modified_base 7: mod_base = OTHER; note = 2'-O-methylcytidine-3'-phosphate
  modified_base 8: mod_base = OTHER; note = 2'-deoxy-2'-fluorocytidine-3'-phosphate
  modified_base 9: mod_base = OTHER; note = 2'-O-methyluridine-3'-phosphate
  modified_base 10: mod_base = OTHER; note = 2'-deoxy-2'-fluoroadenosine-3'-phosphate
  modified_base 11: mod_base = OTHER; note = 2'-O-methylguanosine-3'-phosphate
  modified_base 12: mod_base = OTHER; note = 2'-O-methylguanosine-3'-phosphate
  modified_base 13: mod_base = OTHER; note = 2'-O-methyladenosine-3'-phosphate
  modified_base 14: mod_base = OTHER; note = 2'-deoxy-2'-fluoroadenosine-3'-phosphate
  modified_base 15: mod_base = OTHER; note = 2'-O-methyladenosine-3'-phosphate
  modified_base 16: mod_base = OTHER; note = 2'-deoxy-2'-fluorouridine-3'-phosphate
  modified_base 17: mod_base = OTHER; note = 2'-O-methyladenosine-3'-phosphate
  modified_base 18: mod_base = OTHER; note = 2'-deoxy-2'-fluorocytidine-3'-phosphate
  modified_base 19: mod_base = OTHER; note = 2'-O-methylcytidine-3'-phosphate
  modified_base 20: mod_base = OTHER; note = 2'-deoxy-2'-fluoroadenosine-3'-phosphate
  modified_base 21: mod_base = OTHER; note = 2'-O-methylguanosine-3'-phosphorothioate
  modified_base 22: mod_base = OTHER; note = 2'-O-methyladenosine-3'-phosphorothioate
  modified_base 23: mod_base = OTHER; note = 2'-O-methylguanosine
ttgtaccctaggaaataccagag

SEQ ID NO: 117 - DNA, 23 bp, synthetic construct
  source 1..23: mol_type = other DNA
  modified_base 1: mod_base = OTHER; note = 2'-O-methyluridine-3'-phosphorothioate
  modified_base 2: mod_base = OTHER; note = 2'-deoxythymidine-3'-phosphorothioate
  modified_base 3: mod_base = OTHER; note = 2'-O-methylguanosine-3'-phosphate
  modified_base 4: mod_base = OTHER; note = 2'-O-methyluridine-3'-phosphate
  modified_base 5: mod_base = OTHER; note = 2'-O-methyladenosine-3'-phosphate
  modified_base 6: mod_base = OTHER; note = 2'-O-methylcytidine-3'-phosphate
  modified_base 7: mod_base = OTHER; note = 2'-O-methylcytidine-3'-phosphate
  modified_base 8: mod_base = OTHER; note = 2'-O-methylcytidine-3'-phosphate
  modified_base 9: mod_base = OTHER; note = 2'-O-methyluridine-3'-phosphate
  modified_base 11: mod_base = OTHER; note = 2'-O-methylguanosine-3'-phosphate
  modified_base 12: mod_base = OTHER; note = 2'-O-methylguanosine-3'-phosphate
  modified_base 13: mod_base = OTHER; note = 2'-O-methyladenosine-3'-phosphate
  modified_base 15: mod_base = OTHER; note = 2'-O-methyladenosine-3'-phosphate
  modified_base 16: mod_base = OTHER; note = 2'-O-methyluridine-3'-phosphate
  modified_base 17: mod_base = OTHER; note = 2'-O-methyladenosine-3'-phosphate
  modified_base 18: mod_base = OTHER; note = 2'-O-methylcytidine-3'-phosphate
  modified_base 19: mod_base = OTHER; note = 2'-O-methylcytidine-3'-phosphate
  modified_base 20: mod_base = OTHER; note = 2'-O-methyladenosine-3'-phosphate
  modified_base 21: mod_base = OTHER; note = 2'-O-methylguanosine-3'-phosphorothioate
  modified_base 22: mod_base = OTHER; note = 2'-O-methyladenosine-3'-phosphorothioate
  modified_base 23: mod_base = OTHER; note = 2'-O-methylguanosine
  misc_feature 1: note = RNA
  misc_feature 3..9: note = RNA
  misc_feature 11..13: note = RNA
  misc_feature 15..23: note = RNA
  misc_feature 2: note = DNA
  misc_feature 10: note = DNA
  misc_feature 14: note = DNA
ttgtaccctaggaaataccagag

SEQ ID NO: 118 - DNA, 23 bp, synthetic construct
  source 1..23: mol_type = other DNA
  modified_base 1: mod_base = OTHER; note = 2'-O-methyluridine-3'-phosphorothioate
  modified_base 2: mod_base = OTHER; note = uridine-3'-phosphorothioate
  modified_base 3: mod_base = OTHER; note = 2'-O-methylguanosine-3'-phosphate
  modified_base 4: mod_base = OTHER; note = 2'-O-methyluridine-3'-phosphate
  modified_base 5: mod_base = OTHER; note = 2'-O-methyladenosine-3'-phosphate
  modified_base 6: mod_base = OTHER; note = 2'-O-methylcytidine-3'-phosphate
  modified_base 7: mod_base = OTHER; note = 2'-O-methylcytidine-3'-phosphate
  modified_base 8: mod_base = OTHER; note = 2'-O-methylcytidine-3'-phosphate
  modified_base 9: mod_base = OTHER; note = 2'-O-methyluridine-3'-phosphate
  modified_base 11: mod_base = OTHER; note = 2'-O-methylguanosine-3'-phosphate
  modified_base 12: mod_base = OTHER; note = 2'-O-methylguanosine-3'-phosphate
  modified_base 13: mod_base = OTHER; note = 2'-O-methyladenosine-3'-phosphate
  modified_base 15: mod_base = OTHER; note = 2'-O-methyladenosine-3'-phosphate
  modified_base 16: mod_base = OTHER; note = 2'-O-methyluridine-3'-phosphate
  modified_base 17: mod_base = OTHER; note = 2'-O-methyladenosine-3'-phosphate
  modified_base 18: mod_base = OTHER; note = 2'-O-methylcytidine-3'-phosphate
  modified_base 19: mod_base = OTHER; note = 2'-O-methylcytidine-3'-phosphate
  modified_base 20: mod_base = OTHER; note = 2'-O-methyladenosine-3'-phosphate
  modified_base 21: mod_base = OTHER; note = 2'-O-methylguanosine-3'-phosphorothioate
  modified_base 22: mod_base = OTHER; note = 2'-O-methyladenosine-3'-phosphorothioate
  modified_base 23: mod_base = OTHER; note = 2'-O-methylguanosine
  misc_feature 1..9: note = RNA
  misc_feature 11..13: note = RNA
  misc_feature 15..23: note = RNA
  misc_feature 10: note = DNA
  misc_feature 14: note = DNA
ttgtaccctaggaaataccagag

SEQ ID NO: 119 - RNA, 21 nt, synthetic construct
  source 1..21: mol_type = other RNA
  modified_base 1: mod_base = OTHER; note = 2'-deoxy-2'-fluoroadenosine-3'-phosphorothioate
  modified_base 2: mod_base = OTHER; note = 2'-O-methyladenosine-3'-phosphorothioate
  modified_base 3: mod_base = OTHER; note = 2'-deoxy-2'-fluorocytidine-3'-phosphate
  modified_base 4: mod_base = OTHER; note = 2'-O-methyladenosine-3'-phosphate
  modified_base 5: mod_base = OTHER; note = 2'-deoxy-2'-fluoroguanosine-3'-phosphate
  modified_base 6: mod_base = OTHER; note = 2'-O-methyluridine-3'-phosphate
  modified_base 7: mod_base = OTHER; note = 2'-deoxy-2'-fluoroguanosine-3'-phosphate
  modified_base 8: mod_base = OTHER; note = 2'-O-methyluridine-3'-phosphate
  modified_base 9: mod_base = OTHER; note = 2'-deoxy-2'-fluorouridine-3'-phosphate
  modified_base 10: mod_base = OTHER; note = 2'-deoxy-2'-fluorocytidine-3'-phosphate
  modified_base 11: mod_base = OTHER; note = 2'-deoxy-2'-fluorouridine-3'-phosphate
  modified_base 12: mod_base = OTHER; note = 2'-O-methyluridine-3'-phosphate
  modified_base 13: mod_base = OTHER; note = 2'-deoxy-2'-fluoroguanosine-3'-phosphate
  modified_base 14: mod_base = OTHER; note = 2'-O-methylcytidine-3'-phosphate
  modified_base 15: mod_base = OTHER; note = 2'-deoxy-2'-fluorouridine-3'-phosphate
  modified_base 16: mod_base = OTHER; note = 2'-O-methylcytidine-3'-phosphate
  modified_base 17: mod_base = OTHER; note = 2'-deoxy-2'-fluorouridine-3'-phosphate
  modified_base 18: mod_base = OTHER; note = 2'-O-methyladenosine-3'-phosphate
  modified_base 19: mod_base = OTHER; note = 2'-deoxy-2'-fluorouridine-3'-phosphate
  modified_base 20: mod_base = OTHER; note = 2'-O-methyladenosine-3'-phosphate
  modified_base 21: mod_base = OTHER; note = 2'-deoxy-2'-fluoroadenosine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
aacagtgttcttgctctataa

SEQ ID NO: 120 - DNA, 21 bp, synthetic construct
  source 1..21: mol_type = other DNA
  modified_base 1: mod_base = OTHER; note = 2'-O-methyladenosine-3'-phosphorothioate
  modified_base 2: mod_base = OTHER; note = 2'-O-methyladenosine-3'-phosphorothioate
  modified_base 3: mod_base = OTHER; note = 2'-O-methylcytidine-3'-phosphate
  modified_base 4: mod_base = OTHER; note = 2'-O-methyladenosine-3'-phosphate
  modified_base 5: mod_base = OTHER; note = 2'-O-methylguanosine-3'-phosphate
  modified_base 6: mod_base = OTHER; note = 2'-O-methyluridine-3'-phosphate
  modified_base 7: mod_base = OTHER; note = 2'-O-methylguanosine-3'-phosphate
  modified_base 8: mod_base = OTHER; note = 2'-O-methyluridine-3'-phosphate
  modified_base 9: mod_base = OTHER; note = 2'-O-methyluridine-3'-phosphate
  modified_base 10: mod_base = OTHER; note = 2'-O-methylcytidine-3'-phosphate
  modified_base 12: mod_base = OTHER; note = 2'-O-methyluridine-3'-phosphate
  modified_base 13: mod_base = OTHER; note = 2'-O-methylguanosine-3'-phosphate
  modified_base 14: mod_base = OTHER; note = 2'-O-methylcytidine-3'-phosphate
  modified_base 15: mod_base = OTHER; note = 2'-O-methyluridine-3'-phosphate
  modified_base 16: mod_base = OTHER; note = 2'-O-methylcytidine-3'-phosphate
  modified_base 17: mod_base = OTHER; note = Thymidine-glycol nucleic acid (GNA), S-Isomer
  modified_base 18: mod_base = OTHER; note = 2'-O-methyladenosine-3'-phosphate
  modified_base 19: mod_base = OTHER; note = 2'-O-methyluridine-3'-phosphate
  modified_base 20: mod_base = OTHER; note = 2'-O-methyladenosine-3'-phosphate
  modified_base 21: mod_base = OTHER; note = 2'-O-methyladenosine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
  misc_feature 1..10: note = RNA
  misc_feature 12..21: note = RNA
  misc_feature 11: note = DNA
aacagtgttcttgctctataa

SEQ ID NO: 121 - DNA, 21 bp, synthetic construct
  source 1..21: mol_type = other DNA
  modified_base 1: mod_base = OTHER; note = 2'-O-methyladenosine-3'-phosphorothioate
  modified_base 2: mod_base = OTHER; note = 2'-O-methyladenosine-3'-phosphorothioate
  modified_base 3: mod_base = OTHER; note = 2'-O-methylcytidine-3'-phosphate
  modified_base 4: mod_base = OTHER; note = 2'-O-methyladenosine-3'-phosphate
  modified_base 5: mod_base = OTHER; note = 2'-O-methylguanosine-3'-phosphate
  modified_base 6: mod_base = OTHER; note = 2'-O-methyluridine-3'-phosphate
  modified_base 7: mod_base = OTHER; note = 2'-O-methylguanosine-3'-phosphate
  modified_base 8: mod_base = OTHER; note = 2'-O-methyluridine-3'-phosphate
  modified_base 9: mod_base = OTHER; note = 2'-O-methyluridine-3'-phosphate
  modified_base 10: mod_base = OTHER; note = 2'-O-methylcytidine-3'-phosphate
  modified_base 12: mod_base = OTHER; note = 2'-O-methyluridine-3'-phosphate
  modified_base 13: mod_base = OTHER; note = 2'-O-methylguanosine-3'-phosphate
  modified_base 14: mod_base = OTHER; note = 2'-O-methylcytidine-3'-phosphate
  modified_base 15: mod_base = OTHER; note = 2'-O-methyluridine-3'-phosphate
  modified_base 16: mod_base = OTHER; note = 2'-O-methylcytidine-3'-phosphate
  modified_base 17: mod_base = OTHER; note = Thymidine-glycol nucleic acid (GNA), S-Isomer
  modified_base 18: mod_base = OTHER; note = 2'-O-methyladenosine-3'-phosphate
  modified_base 19: mod_base = OTHER; note = 2'-O-methyluridine-3'-phosphate
  modified_base 20: mod_base = OTHER; note = 2'-O-methyladenosine-3'-phosphate
  modified_base 21: mod_base = OTHER; note = 2'-O-methyladenosine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
  misc_feature 1..10: note = RNA
  misc_feature 12..21: note = RNA
  misc_feature 11: note = DNA
aacagtgttcttgctctataa

SEQ ID NO: 122 - DNA, 21 bp, synthetic construct
  source 1..21: mol_type = other DNA
  modified_base 1: mod_base = OTHER; note = 2'-O-methyladenosine-3'-phosphorothioate
  modified_base 2: mod_base = OTHER; note = 2'-O-methyladenosine-3'-phosphorothioate
  modified_base 3: mod_base = OTHER; note = 2'-O-methylcytidine-3'-phosphate
  modified_base 4: mod_base = OTHER; note = 2'-O-methyladenosine-3'-phosphate
  modified_base 5: mod_base = OTHER; note = 2'-O-methylguanosine-3'-phosphate
  modified_base 6: mod_base = OTHER; note = 2'-O-methyluridine-3'-phosphate
  modified_base 7: mod_base = OTHER; note = 2'-O-methylguanosine-3'-phosphate
  modified_base 8: mod_base = OTHER; note = 2'-O-methyluridine-3'-phosphate
  modified_base 9: mod_base = OTHER; note = 2'-O-methyluridine-3'-phosphate
  modified_base 10: mod_base = OTHER; note = 2'-O-methylcytidine-3'-phosphate
  modified_base 12: mod_base = OTHER; note = 2'-O-methyluridine-3'-phosphate
  modified_base 13: mod_base = OTHER; note = 2'-O-methylguanosine-3'-phosphate
  modified_base 14: mod_base = OTHER; note = 2'-O-methylcytidine-3'-phosphate
  modified_base 15: mod_base = OTHER; note = 2'-O-methyluridine-3'-phosphate
  modified_base 16: mod_base = OTHER; note = 2'-O-methylcytidine-3'-phosphate
  modified_base 17: mod_base = OTHER; note = Thymidine-glycol nucleic acid (GNA), S-Isomer
  modified_base 18: mod_base = OTHER; note = 2'-O-methyladenosine-3'-phosphate
  modified_base 19: mod_base = OTHER; note = 2'-O-methyluridine-3'-phosphate
  modified_base 20: mod_base = OTHER; note = 2'-O-methyladenosine-3'-phosphate
  modified_base 21: mod_base = OTHER; note = 2'-O-methyladenosine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
  misc_feature 1..10: note = RNA
  misc_feature 12..21: note = RNA
  misc_feature 11: note = DNA
aacagtgttcttgctctataa

SEQ ID NO: 123 - RNA, 21 nt, synthetic construct
  source 1..21: mol_type = other RNA
  modified_base 1: mod_base = OTHER; note = 2'-deoxy-2'-fluoroguanosine-3'-phosphorothioate
  modified_base 2: mod_base = OTHER; note = 2'-O-methylcytidine-3'-phosphorothioate
  modified_base 3: mod_base = OTHER; note = 2'-deoxy-2'-fluorouridine-3'-phosphate
  modified_base 4: mod_base = OTHER; note = 2'-O-methyluridine-3'-phosphate
  modified_base 5: mod_base = OTHER; note = 2'-deoxy-2'-fluoroadenosine-3'-phosphate
  modified_base 6: mod_base = OTHER; note = 2'-O-methyladenosine-3'-phosphate
  modified_base 7: mod_base = OTHER; note = 2'-deoxy-2'-fluoroadenosine-3'-phosphate
  modified_base 8: mod_base = OTHER; note = 2'-O-methyladenosine-3'-phosphate
  modified_base 9: mod_base = OTHER; note = 2'-deoxy-2'-fluoroguanosine-3'-phosphate
  modified_base 10: mod_base = OTHER; note = 2'-deoxy-2'-fluoroguanosine-3'-phosphate
  modified_base 11: mod_base = OTHER; note = 2'-deoxy-2'-fluoroguanosine-3'-phosphate
  modified_base 12: mod_base = OTHER; note = 2'-O-methyladenosine-3'-phosphate
  modified_base 13: mod_base = OTHER; note = 2'-deoxy-2'-fluorocytidine-3'-phosphate
  modified_base 14: mod_base = OTHER; note = 2'-O-methyladenosine-3'-phosphate
  modified_base 15: mod_base = OTHER; note = 2'-deoxy-2'-fluoroguanosine-3'-phosphate
  modified_base 16: mod_base = OTHER; note = 2'-O-methyluridine-3'-phosphate
  modified_base 17: mod_base = OTHER; note = 2'-deoxy-2'-fluoroadenosine-3'-phosphate
  modified_base 18: mod_base = OTHER; note = 2'-O-methyluridine-3'-phosphate
  modified_base 19: mod_base = OTHER; note = 2'-deoxy-2'-fluorouridine-3'-phosphate
  modified_base 20: mod_base = OTHER; note = 2'-O-methylcytidine-3'-phosphate
  modified_base 21: mod_base = OTHER; note = 2'-deoxy-2'-fluorouridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
gcttaaaagggacagtattct

SEQ ID NO: 124 - RNA, 21 nt, synthetic construct
  source 1..21: mol_type = other RNA
  modified_base 1: mod_base = OTHER; note = 2'-deoxy-2'-fluoroguanosine-3'-phosphorothioate
  modified_base 2: mod_base = OTHER; note = 2'-O-methylcytidine-3'-phosphorothioate
  modified_base 3: mod_base = OTHER; note = 2'-deoxy-2'-fluorouridine-3'-phosphate
  modified_base 4: mod_base = OTHER; note = 2'-O-methyluridine-3'-phosphate
  modified_base 5: mod_base = OTHER; note = 2'-deoxy-2'-fluoroadenosine-3'-phosphate
  modified_base 6: mod_base = OTHER; note = 2'-O-methyladenosine-3'-phosphate
  modified_base 7: mod_base = OTHER; note = 2'-deoxy-2'-fluoroadenosine-3'-phosphate
  modified_base 8: mod_base = OTHER; note = 2'-O-methyladenosine-3'-phosphate
  modified_base 9: mod_base = OTHER; note = 2'-deoxy-2'-fluoroguanosine-3'-phosphate
  modified_base 10: mod_base = OTHER; note = 2'-deoxy-2'-fluoroguanosine-3'-phosphate
  modified_base 11: mod_base = OTHER; note = 2'-deoxy-2'-fluoroguanosine-3'-phosphate
  modified_base 12: mod_base = OTHER; note = 2'-O-methyladenosine-3'-phosphate
  modified_base 13: mod_base = OTHER; note = 2'-deoxy-2'-fluorocytidine-3'-phosphate
  modified_base 14: mod_base = OTHER; note = 2'-O-methyladenosine-3'-phosphate
  modified_base 15: mod_base = OTHER; note = 2'-deoxy-2'-fluoroguanosine-3'-phosphate
  modified_base 16: mod_base = OTHER; note = 2'-O-methyluridine-3'-phosphate
  modified_base 17: mod_base = OTHER; note = 2'-deoxy-2'-fluoroadenosine-3'-phosphate
  modified_base 18: mod_base = OTHER; note = 2'-O-methyluridine-3'-phosphate
  modified_base 19: mod_base = OTHER; note = 2'-deoxy-2'-fluorouridine-3'-phosphate
  modified_base 20: mod_base = OTHER; note = 2'-O-methylcytidine-3'-phosphate
  modified_base 21: mod_base = OTHER; note = 2'-deoxy-2'-fluorouridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
gcttaaaagggacagtattct

SEQ ID NO: 125 - RNA, 21 nt, synthetic construct
  source 1..21: mol_type = other RNA
  modified_base 1: mod_base = OTHER; note = 2'-deoxy-2'-fluoroguanosine-3'-phosphorothioate
  modified_base 2: mod_base = OTHER; note = 2'-O-methylcytidine-3'-phosphorothioate
  modified_base 3: mod_base = OTHER; note = 2'-deoxy-2'-fluorouridine-3'-phosphate
  modified_base 4: mod_base = OTHER; note = 2'-O-methyluridine-3'-phosphate
  modified_base 5: mod_base = OTHER; note = 2'-deoxy-2'-fluoroadenosine-3'-phosphate
  modified_base 6: mod_base = OTHER; note = 2'-O-methyladenosine-3'-phosphate
  modified_base 7: mod_base = OTHER; note = 2'-deoxy-2'-fluoroadenosine-3'-phosphate
  modified_base 8: mod_base = OTHER; note = 2'-O-methyladenosine-3'-phosphate
  modified_base 9: mod_base = OTHER; note = 2'-deoxy-2'-fluoroguanosine-3'-phosphate
  modified_base 10: mod_base = OTHER; note = 2'-deoxy-2'-fluoroguanosine-3'-phosphate
  modified_base 11: mod_base = OTHER; note = 2'-deoxy-2'-fluoroguanosine-3'-phosphate
  modified_base 12: mod_base = OTHER; note = 2'-O-methyladenosine-3'-phosphate
  modified_base 13: mod_base = OTHER; note = 2'-deoxy-2'-fluorocytidine-3'-phosphate
  modified_base 14: mod_base = OTHER; note = 2'-O-methyladenosine-3'-phosphate
  modified_base 15: mod_base = OTHER; note = 2'-deoxy-2'-fluoroguanosine-3'-phosphate
  modified_base 16: mod_base = OTHER; note = 2'-O-methyluridine-3'-phosphate
  modified_base 17: mod_base = OTHER; note = 2'-deoxy-2'-fluoroadenosine-3'-phosphate
  modified_base 18: mod_base = OTHER; note = 2'-O-methyluridine-3'-phosphate
  modified_base 19: mod_base = OTHER; note = 2'-deoxy-2'-fluorouridine-3'-phosphate
  modified_base 20: mod_base = OTHER; note = 2'-O-methylcytidine-3'-phosphate
  modified_base 21: mod_base = OTHER; note = 2'-deoxy-2'-fluorouridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
gcttaaaagggacagtattct

SEQ ID NO: 126 - RNA, 21 nt, synthetic construct
  source 1..21: mol_type = other RNA
  modified_base 1: mod_base = OTHER; note = 2'-deoxy-2'-fluorouridine-3'-phosphorothioate
  modified_base 2: mod_base = OTHER; note = 2'-O-methylguanosine-3'-phosphorothioate
  modified_base 3: mod_base = OTHER; note = 2'-deoxy-2'-fluoroguanosine-3'-phosphate
  modified_base 4: mod_base = OTHER; note = 2'-O-methylguanosine-3'-phosphate
  modified_base 5: mod_base = OTHER; note = 2'-deoxy-2'-fluoroadenosine-3'-phosphate
  modified_base 6: mod_base = OTHER; note = 2'-O-methyluridine-3'-phosphate
  modified_base 7: mod_base = OTHER; note = 2'-deoxy-2'-fluorouridine-3'-phosphate
  modified_base 8: mod_base = OTHER; note = 2'-O-methyluridine-3'-phosphate
  modified_base 9: mod_base = OTHER; note = 2'-deoxy-2'-fluorocytidine-3'-phosphate
  modified_base 10: mod_base = OTHER; note = 2'-deoxy-2'-fluoroadenosine-3'-phosphate
  modified_base 11: mod_base = OTHER; note = 2'-deoxy-2'-fluorouridine-3'-phosphate
  modified_base 12: mod_base = OTHER; note = 2'-O-methylguanosine-3'-phosphate
  modified_base 13: mod_base = OTHER; note = 2'-deoxy-2'-fluorouridine-3'-phosphate
  modified_base 14: mod_base = OTHER; note = 2'-O-methyladenosine-3'-phosphate
  modified_base 15: mod_base = OTHER; note = 2'-deoxy-2'-fluoroadenosine-3'-phosphate
  modified_base 16: mod_base = OTHER; note = 2'-O-methylcytidine-3'-phosphate
  modified_base 17: mod_base = OTHER; note = 2'-deoxy-2'-fluorocytidine-3'-phosphate
  modified_base 18: mod_base = OTHER; note = 2'-O-methyladenosine-3'-phosphate
  modified_base 19: mod_base = OTHER; note = 2'-deoxy-2'-fluoroadenosine-3'-phosphate
  modified_base 20: mod_base = OTHER; note = 2'-O-methylguanosine-3'-phosphate
  modified_base 21: mod_base = OTHER; note = 2'-deoxy-2'-fluoroadenosine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
tgggatttcatgtaaccaaga

SEQ ID NO: 127 - RNA, 21 nt, synthetic construct
  source 1..21: mol_type = other RNA
  modified_base 1: mod_base = OTHER; note = 2'-deoxy-2'-fluorouridine-3'-phosphorothioate
  modified_base 2: mod_base = OTHER; note = 2'-O-methylguanosine-3'-phosphorothioate
  modified_base 3: mod_base = OTHER; note = 2'-deoxy-2'-fluoroguanosine-3'-phosphate
  modified_base 4: mod_base = OTHER; note = 2'-O-methylguanosine-3'-phosphate
  modified_base 5: mod_base = OTHER; note = 2'-deoxy-2'-fluoroadenosine-3'-phosphate
  modified_base 6: mod_base = OTHER; note = 2'-O-methyluridine-3'-phosphate
  modified_base 7: mod_base = OTHER; note = 2'-deoxy-2'-fluorouridine-3'-phosphate
  modified_base 8: mod_base = OTHER; note = 2'-O-methyluridine-3'-phosphate
  modified_base 9: mod_base = OTHER; note = 2'-deoxy-2'-fluorocytidine-3'-phosphate
  modified_base 10: mod_base = OTHER; note = 2'-deoxy-2'-fluoroadenosine-3'-phosphate
  modified_base 11: mod_base = OTHER; note = 2'-deoxy-2'-fluorouridine-3'-phosphate
  modified_base 12: mod_base = OTHER; note = 2'-O-methylguanosine-3'-phosphate
  modified_base 13: mod_base = OTHER; note = 2'-deoxy-2'-fluorouridine-3'-phosphate
  modified_base 14: mod_base = OTHER; note = 2'-O-methyladenosine-3'-phosphate
  modified_base 15: mod_base = OTHER; note = 2'-deoxy-2'-fluoroadenosine-3'-phosphate
  modified_base 16: mod_base = OTHER; note = 2'-O-methylcytidine-3'-phosphate
  modified_base 17: mod_base = OTHER; note = 2'-deoxy-2'-fluorocytidine-3'-phosphate
  modified_base 18: mod_base = OTHER; note = 2'-O-methyladenosine-3'-phosphate
  modified_base 19: mod_base = OTHER; note = 2'-deoxy-2'-fluoroadenosine-3'-phosphate
  modified_base 20: mod_base = OTHER; note = 2'-O-methylguanosine-3'-phosphate
  modified_base 21: mod_base = OTHER; note = 2'-deoxy-2'-fluoroadenosine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
tgggatttcatgtaaccaaga

SEQ ID NO: 128 - RNA, 21 nt, synthetic construct
  source 1..21: mol_type = other RNA
  modified_base 1: mod_base = OTHER; note = 2'-deoxy-2'-fluorouridine-3'-phosphorothioate
  modified_base 2: mod_base = OTHER; note = 2'-O-methylguanosine-3'-phosphorothioate
  modified_base 3: mod_base = OTHER; note = 2'-deoxy-2'-fluoroguanosine-3'-phosphate
  modified_base 4: mod_base = OTHER; note = 2'-O-methylguanosine-3'-phosphate
  modified_base 5: mod_base = OTHER; note = 2'-deoxy-2'-fluoroadenosine-3'-phosphate
  modified_base 6: mod_base = OTHER; note = 2'-O-methyluridine-3'-phosphate
  modified_base 7: mod_base = OTHER; note = 2'-deoxy-2'-fluorouridine-3'-phosphate
  modified_base 8: mod_base = OTHER; note = 2'-O-methyluridine-3'-phosphate
  modified_base 9: mod_base = OTHER; note = 2'-deoxy-2'-fluorocytidine-3'-phosphate
  modified_base 10: mod_base = OTHER; note = 2'-deoxy-2'-fluoroadenosine-3'-phosphate
  modified_base 11: mod_base = OTHER; note = 2'-deoxy-2'-fluorouridine-3'-phosphate
  modified_base 12: mod_base = OTHER; note = 2'-O-methylguanosine-3'-phosphate
  modified_base 13: mod_base = OTHER; note = 2'-deoxy-2'-fluorouridine-3'-phosphate
  modified_base 14: mod_base = OTHER; note = 2'-O-methyladenosine-3'-phosphate
  modified_base 15: mod_base = OTHER; note = 2'-deoxy-2'-fluoroadenosine-3'-phosphate
  modified_base 16: mod_base = OTHER; note = 2'-O-methylcytidine-3'-phosphate
  modified_base 17: mod_base = OTHER; note = 2'-deoxy-2'-fluorocytidine-3'-phosphate
  modified_base 18: mod_base = OTHER; note = 2'-O-methyladenosine-3'-phosphate
  modified_base 19: mod_base = OTHER; note = 2'-deoxy-2'-fluoroadenosine-3'-phosphate
  modified_base 20: mod_base = OTHER; note = 2'-O-methylguanosine-3'-phosphate
  modified_base 21: mod_base = OTHER; note = 2'-deoxy-2'-fluoroadenosine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
tgggatttcatgtaaccaaga

SEQ ID NO: 129 - DNA, 21 bp, synthetic construct
  source 1..21: mol_type = other DNA
  modified_base 1: mod_base = OTHER; note = 2'-O-methyluridine-3'-phosphorothioate
  modified_base 2: mod_base = OTHER; note = 2'-O-methylguanosine-3'-phosphorothioate
  modified_base 3: mod_base = OTHER; note = 2'-O-methylguanosine-3'-phosphate
  modified_base 4: mod_base = OTHER; note = 2'-O-methylguanosine-3'-phosphate
  modified_base 5: mod_base = OTHER; note = 2'-O-methyladenosine-3'-phosphate
  modified_base 6: mod_base = OTHER; note = 2'-O-methyluridine-3'-phosphate
  modified_base 7: mod_base = OTHER; note = 2'-O-methyluridine-3'-phosphate
  modified_base 8: mod_base = OTHER; note = 2'-O-methyluridine-3'-phosphate
  modified_base 9: mod_base = OTHER; note = 2'-O-methylcytidine-3'-phosphate
  modified_base 10: mod_base = OTHER; note = 2'-O-methyladenosine-3'-phosphate
  modified_base 12: mod_base = OTHER; note = 2'-O-methylguanosine-3'-phosphate
  modified_base 13: mod_base = OTHER; note = 2'-O-methyluridine-3'-phosphate
  modified_base 14: mod_base = OTHER; note = 2'-O-methyladenosine-3'-phosphate
  modified_base 15: mod_base = OTHER; note = 2'-O-methyladenosine-3'-phosphate
  modified_base 16: mod_base = OTHER; note = 2'-O-methylcytidine-3'-phosphate
  modified_base 17: mod_base = OTHER; note = Cytidine-glycol nucleic acid (GNA), S-isomer
  modified_base 18: mod_base = OTHER; note = 2'-O-methyladenosine-3'-phosphate
  modified_base 19: mod_base = OTHER; note = 2'-O-methyladenosine-3'-phosphate
  modified_base 20: mod_base = OTHER; note = 2'-O-methylguanosine-3'-phosphate
  modified_base 21: mod_base = OTHER; note = 2'-O-methyladenosine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
  misc_feature 1..10: note = RNA
  misc_feature 12..21: note = RNA
  misc_feature 11: note = DNA
tgggatttcatgtaaccaaga

SEQ ID NO: 130 - DNA, 21 bp, synthetic construct
  source 1..21: mol_type = other DNA
  modified_base 1: mod_base = OTHER; note = 2'-O-methyluridine-3'-phosphorothioate
  modified_base 2: mod_base = OTHER; note = 2'-O-methylguanosine-3'-phosphorothioate
  modified_base 3: mod_base = OTHER; note = 2'-O-methylguanosine-3'-phosphate
  modified_base 4: mod_base = OTHER; note = 2'-O-methylguanosine-3'-phosphate
  modified_base 5: mod_base = OTHER; note = 2'-O-methyladenosine-3'-phosphate
  modified_base 6: mod_base = OTHER; note = 2'-O-methyluridine-3'-phosphate
  modified_base 7: mod_base = OTHER; note = 2'-O-methyluridine-3'-phosphate
  modified_base 8: mod_base = OTHER; note = 2'-O-methyluridine-3'-phosphate
  modified_base 9: mod_base = OTHER; note = 2'-O-methylcytidine-3'-phosphate
  modified_base 10: mod_base = OTHER; note = 2'-O-methyladenosine-3'-phosphate
  modified_base 12: mod_base = OTHER; note = 2'-O-methylguanosine-3'-phosphate
  modified_base 13: mod_base = OTHER; note = 2'-O-methyluridine-3'-phosphate
  modified_base 14: mod_base = OTHER; note = 2'-O-methyladenosine-3'-phosphate
  modified_base 15: mod_base = OTHER; note = 2'-O-methyladenosine-3'-phosphate
  modified_base 16: mod_base = OTHER; note = 2'-O-methylcytidine-3'-phosphate
  modified_base 17: mod_base = OTHER; note = Cytidine-glycol nucleic acid (GNA), S-isomer
  modified_base 18: mod_base = OTHER; note = 2'-O-methyladenosine-3'-phosphate
  modified_base 19: mod_base = OTHER; note = 2'-O-methyladenosine-3'-phosphate
  modified_base 20: mod_base = OTHER; note = 2'-O-methylguanosine-3'-phosphate
  modified_base 21: mod_base = OTHER; note = 2'-O-methyladenosine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
  misc_feature 1..10: note = RNA
  misc_feature 12..21: note = RNA
  misc_feature 11: note = DNA
tgggatttcatgtaaccaaga

SEQ ID NO: 131 - RNA, 23 nt, synthetic construct
  source 1..23: mol_type = other RNA
  modified_base 1: mod_base = OTHER; note = 2'-O-methyluridine-3'-phosphorothioate
  modified_base 2: mod_base = OTHER; note = 2'-deoxy-2'-fluorouridine-3'-phosphorothioate
  modified_base 3: mod_base = OTHER; note = 2'-O-methyladenosine-3'-phosphate
  modified_base 4: mod_base = OTHER; note = 2'-deoxy-2'-fluorouridine-3'-phosphate
  modified_base 5: mod_base = OTHER; note = 2'-O-methyladenosine-3'-phosphate
  modified_base 6: mod_base = OTHER; note = 2'-deoxy-2'-fluoroguanosine-3'-phosphate
  modified_base 7: mod_base = OTHER; note = 2'-O-methyladenosine-3'-phosphate
  modified_base 8: mod_base = OTHER; note = 2'-deoxy-2'-fluoroguanosine-3'-phosphate
  modified_base 9: mod_base = OTHER; note = 2'-O-methylcytidine-3'-phosphate
  modified_base 10: mod_base = OTHER; note = 2'-deoxy-2'-fluoroadenosine-3'-phosphate
  modified_base 11: mod_base = OTHER; note = 2'-O-methyladenosine-3'-phosphate
  modified_base 12: mod_base = OTHER; note = 2'-O-methylguanosine-3'-phosphate
  modified_base 13: mod_base = OTHER; note = 2'-O-methyladenosine-3'-phosphate
  modified_base 14: mod_base = OTHER; note = 2'-deoxy-2'-fluoroadenosine-3'-phosphate
  modified_base 15: mod_base = OTHER; note = 2'-O-methylcytidine-3'-phosphate
  modified_base 16: mod_base = OTHER; note = 2'-deoxy-2'-fluoroadenosine-3'-phosphate
  modified_base 17: mod_base = OTHER; note = 2'-O-methylcytidine-3'-phosphate
  modified_base 18: mod_base = OTHER; note = 2'-deoxy-2'-fluorouridine-3'-phosphate
  modified_base 19: mod_base = OTHER; note = 2'-O-methylguanosine-3'-phosphate
  modified_base 20: mod_base = OTHER; note = 2'-deoxy-2'-fluorouridine-3'-phosphate
  modified_base 21: mod_base = OTHER; note = 2'-O-methyluridine-3'-phosphorothioate
  modified_base 22: mod_base = OTHER; note = 2'-O-methyluridine-3'-phosphorothioate
  modified_base 23: mod_base = OTHER; note = 2'-O-methyluridine
ttatagagcaagaacactgtttt

SEQ ID NO: 132 - DNA, 23 bp, synthetic construct
  source 1..23: mol_type = other DNA
  modified_base 1: mod_base = OTHER; note = 2'-O-methyluridine-3'-phosphorothioate
  modified_base 2: mod_base = OTHER; note = 2'-deoxythymidine-3'-phosphorothioate
  modified_base 3: mod_base = OTHER; note = 2'-O-methyladenosine-3'-phosphate
  modified_base 4: mod_base = OTHER; note = 2'-O-methyluridine-3'-phosphate
  modified_base 5: mod_base = OTHER; note = 2'-O-methyladenosine-3'-phosphate
  modified_base 6: mod_base = OTHER; note = 2'-O-methylguanosine-3'-phosphate
  modified_base 7: mod_base = OTHER; note = 2'-O-methyladenosine-3'-phosphate
  modified_base 8: mod_base = OTHER; note = 2'-O-methylguanosine-3'-phosphate
  modified_base 9: mod_base = OTHER; note = 2'-O-methylcytidine-3'-phosphate
  modified_base 11: mod_base = OTHER; note = 2'-O-methyladenosine-3'-phosphate
  modified_base 12: mod_base = OTHER; note = 2'-O-methylguanosine-3'-phosphate
  modified_base 13: mod_base = OTHER; note = 2'-O-methyladenosine-3'-phosphate
  modified_base 15: mod_base = OTHER; note = 2'-O-methylcytidine-3'-phosphate
  modified_base 16: mod_base = OTHER; note = 2'-O-methyladenosine-3'-phosphate
  modified_base 17: mod_base = OTHER; note = 2'-O-methylcytidine-3'-phosphate
  modified_base 18: mod_base = OTHER; note = 2'-O-methyluridine-3'-phosphate
  modified_base 19: mod_base = OTHER; note = 2'-O-methylguanosine-3'-phosphate
  modified_base 20: mod_base = OTHER; note = 2'-O-methyluridine-3'-phosphate
  modified_base 21: mod_base = OTHER; note = 2'-O-methyluridine-3'-phosphorothioate
  modified_base 22: mod_base = OTHER; note = 2'-O-methyluridine-3'-phosphorothioate
  modified_base 23: mod_base = OTHER; note = 2'-O-methyluridine
  misc_feature 1: note = RNA
  misc_feature 3..9: note = RNA
  misc_feature 11..13: note = RNA
  misc_feature 15..23: note = RNA
  misc_feature 2: note = DNA
  misc_feature 10: note = DNA
  misc_feature 14: note = DNA
ttatagagcaagaacactgtttt

SEQ ID NO: 133 - DNA, 23 bp, synthetic construct
  source 1..23: mol_type = other DNA
  modified_base 1: mod_base = OTHER; note = 2'-O-methyluridine-3'-phosphorothioate
  modified_base 2: mod_base = OTHER; note = 2'-deoxythymidine-3'-phosphorothioate
  modified_base 3: mod_base = OTHER; note = 2'-O-methyladenosine-3'-phosphate
  modified_base 4: mod_base = OTHER; note = 2'-O-methyluridine-3'-phosphate
  modified_base 5: mod_base = OTHER; note = 2'-O-methyladenosine-3'-phosphate
  modified_base 6: mod_base = OTHER; note = 2'-O-methylguanosine-3'-phosphate
  modified_base 7: mod_base = OTHER; note = 2'-O-methyladenosine-3'-phosphate
  modified_base 8: mod_base = OTHER; note = 2'-O-methylguanosine-3'-phosphate
  modified_base 9: mod_base = OTHER; note = 2'-O-methylcytidine-3'-phosphate
  modified_base 11: mod_base = OTHER; note = 2'-O-methyladenosine-3'-phosphate
  modified_base 12: mod_base = OTHER; note = 2'-O-methylguanosine-3'-phosphate
  modified_base 13: mod_base = OTHER; note = 2'-O-methyladenosine-3'-phosphate
  modified_base 14: mod_base = OTHER; note = adenosine-3'-phosphate
  modified_base 15: mod_base = OTHER; note = 2'-O-methylcytidine-3'-phosphate
  modified_base 16: mod_base = OTHER; note = 2'-O-methyladenosine-3'-phosphate
  modified_base 17: mod_base = OTHER; note = 2'-O-methylcytidine-3'-phosphate
  modified_base 18: mod_base = OTHER; note = 2'-O-methyluridine-3'-phosphate
  modified_base 19: mod_base = OTHER; note = 2'-O-methylguanosine-3'-phosphate
  modified_base 20: mod_base = OTHER; note = 2'-O-methyluridine-3'-phosphate
  modified_base 21: mod_base = OTHER; note = 2'-O-methyluridine-3'-phosphorothioate
  modified_base 22: mod_base = OTHER; note = 2'-O-methyluridine-3'-phosphorothioate
  modified_base 23: mod_base = OTHER; note = 2'-O-methyluridine
  misc_feature 1: note = RNA
  misc_feature 3..9: note = RNA
  misc_feature 11..23: note = RNA
  misc_feature 2: note = DNA
  misc_feature 10: note = DNA
ttatagagcaagaacactgtttt

SEQ ID NO: 134 - DNA, 23 bp, synthetic construct
  source 1..23: mol_type = other DNA
  modified_base 1: mod_base = OTHER; note = 2'-O-methyluridine-3'-phosphorothioate
  modified_base 2: mod_base = OTHER; note = 2'-deoxythymidine-3'-phosphorothioate
  modified_base 3: mod_base = OTHER; note = 2'-O-methyladenosine-3'-phosphate
  modified_base 4: mod_base = OTHER; note = 2'-O-methyluridine-3'-phosphate
  modified_base 5: mod_base = OTHER; note = 2'-O-methyladenosine-3'-phosphate
  modified_base 6: mod_base = OTHER; note = 2'-O-methylguanosine-3'-phosphate
  modified_base 7: mod_base = OTHER; note = 2'-O-methyladenosine-3'-phosphate
  modified_base 8: mod_base = OTHER; note = 2'-O-methylguanosine-3'-phosphate
  modified_base 9: mod_base = OTHER; note = 2'-O-methylcytidine-3'-phosphate
  modified_base 11: mod_base = OTHER; note = 2'-O-methyladenosine-3'-phosphate
  modified_base 12: mod_base = OTHER; note = 2'-O-methylguanosine-3'-phosphate
  modified_base 13: mod_base = OTHER; note = 2'-O-methyladenosine-3'-phosphate
  modified_base 14: mod_base = OTHER; note = 2'-O,4'-C-methylene adenosine-3'-phosphate
  modified_base 15: mod_base = OTHER; note = 2'-O-methylcytidine-3'-phosphate
  modified_base 16: mod_base = OTHER; note = 2'-O-methyladenosine-3'-phosphate
  modified_base 17: mod_base = OTHER; note = 2'-O-methylcytidine-3'-phosphate
  modified_base 18: mod_base = OTHER; note = 2'-O-methyluridine-3'-phosphate
  modified_base 19: mod_base = OTHER; note = 2'-O-methylguanosine-3'-phosphate
  modified_base 20: mod_base = OTHER; note = 2'-O-methyluridine-3'-phosphate
  modified_base 21: mod_base = OTHER; note = 2'-O-methyluridine-3'-phosphorothioate
  modified_base 22: mod_base = OTHER; note = 2'-O-methyluridine-3'-phosphorothioate
  modified_base 23: mod_base = OTHER; note = 2'-O-methyluridine
  misc_feature 1: note = RNA
  misc_feature 3..9: note = RNA
  misc_feature 11..23: note = RNA
  misc_feature 2: note = DNA
  misc_feature 10: note = DNA
ttatagagcaagaacactgtttt

SEQ ID NO: 135 - RNA, 23 nt, synthetic construct
  source 1..23: mol_type = other RNA
  modified_base 1: mod_base = OTHER; note = 2'-O-methyladenosine-3'-phosphorothioate
  modified_base 2: mod_base = OTHER; note = 2'-deoxy-2'-fluoroguanosine-3'-phosphorothioate
  modified_base 3: mod_base = OTHER; note = 2'-O-methyladenosine-3'-phosphate
  modified_base 4: mod_base = OTHER; note = 2'-deoxy-2'-fluoroadenosine-3'-phosphate
  modified_base 5: mod_base = OTHER; note = 2'-O-methyluridine-3'-phosphate
  modified_base 6: mod_base = OTHER; note = 2'-deoxy-2'-fluoroadenosine-3'-phosphate
  modified_base 7: mod_base = OTHER; note = 2'-O-methylcytidine-3'-phosphate
  modified_base 8: mod_base = OTHER; note = 2'-deoxy-2'-fluorouridine-3'-phosphate
  modified_base 9: mod_base = OTHER; note = 2'-O-methylguanosine-3'-phosphate
  modified_base 10: mod_base = OTHER; note = 2'-deoxy-2'-fluorouridine-3'-phosphate
  modified_base 11: mod_base = OTHER; note = 2'-O-methylcytidine-3'-phosphate
  modified_base 12: mod_base = OTHER; note = 2'-O-methylcytidine-3'-phosphate
  modified_base 13: mod_base = OTHER; note = 2'-O-methylcytidine-3'-phosphate
  modified_base 14: mod_base = OTHER; note = 2'-deoxy-2'-fluorouridine-3'-phosphate
  modified_base 15: mod_base = OTHER; note = 2'-O-methyluridine-3'-phosphate
  modified_base 16: mod_base = OTHER; note = 2'-deoxy-2'-fluorouridine-3'-phosphate
  modified_base 17: mod_base = OTHER; note = 2'-O-methyluridine-3'-phosphate
  modified_base 18: mod_base = OTHER; note = 2'-deoxy-2'-fluoroadenosine-3'-phosphate
  modified_base 19: mod_base = OTHER; note = 2'-O-methyladenosine-3'-phosphate
  modified_base 20: mod_base = OTHER; note = 2'-deoxy-2'-fluoroguanosine-3'-phosphate
  modified_base 21: mod_base = OTHER; note = 2'-O-methylcytidine-3'-phosphorothioate
  modified_base 22: mod_base = OTHER; note = 2'-O-methyladenosine-3'-phosphorothioate
  modified_base 23: mod_base = OTHER; note = 2'-O-methyladenosine
agaatactgtcccttttaagcaa

SEQ ID NO: 136 - DNA, 23 bp, synthetic construct
  source 1..23: mol_type = other DNA
  modified_base 1: mod_base = OTHER; note = 2'-O-methyladenosine-3'-phosphorothioate
  modified_base 2: mod_base = OTHER; note = 2'-deoxyguanosine-3'-phosphorothioate
  modified_base 3: mod_base = OTHER; note = 2'-O-methyladenosine-3'-phosphate
  modified_base 4: mod_base = OTHER; note = 2'-O-methyladenosine-3'-phosphate
  modified_base 5: mod_base = OTHER; note = 2'-O-methyluridine-3'-phosphate
  modified_base 6: mod_base = OTHER; note = 2'-O-methyladenosine-3'-phosphate
  modified_base 7: mod_base = OTHER; note = 2'-O-methylcytidine-3'-phosphate
  modified_base 8: mod_base = OTHER; note = 2'-O-methyluridine-3'-phosphate
  modified_base 9: mod_base = OTHER; note = 2'-O-methylguanosine-3'-phosphate
  modified_base 11: mod_base = OTHER; note = 2'-O-methylcytidine-3'-phosphate
  modified_base 12: mod_base = OTHER; note = 2'-O-methylcytidine-3'-phosphate
  modified_base 13: mod_base = OTHER; note = 2'-O-methylcytidine-3'-phosphate
  modified_base 15: mod_base = OTHER; note = 2'-O-methyluridine-3'-phosphate
  modified_base 16: mod_base = OTHER; note = 2'-O-methyluridine-3'-phosphate
  modified_base 17: mod_base = OTHER; note = 2'-O-methyluridine-3'-phosphate
  modified_base 18: mod_base = OTHER; note = 2'-O-methyladenosine-3'-phosphate
  modified_base 19: mod_base = OTHER; note = 2'-O-methyladenosine-3'-phosphate
  modified_base 20: mod_base = OTHER; note = 2'-O-methylguanosine-3'-phosphate
  modified_base 21: mod_base = OTHER; note = 2'-O-methylcytidine-3'-phosphorothioate
  modified_base 22: mod_base = OTHER; note = 2'-O-methyladenosine-3'-phosphorothioate
  modified_base 23: mod_base = OTHER; note = 2'-O-methyladenosine
  misc_feature 1: note = RNA
  misc_feature 3..9: note = RNA
  misc_feature 11..13: note = RNA
  misc_feature 15..23: note = RNA
  misc_feature 2: note = DNA
  misc_feature 10: note = DNA
  misc_feature 14: note = DNA
agaatactgtcccttttaagcaa

SEQ ID NO: 137 - DNA, 23 bp, synthetic construct
  source 1..23: mol_type = other DNA
  modified_base 1: mod_base = OTHER; note = 2'-O-methyladenosine-3'-phosphorothioate
  modified_base 2: mod_base = OTHER; note = 2'-deoxyguanosine-3'-phosphorothioate
  modified_base 3: mod_base = OTHER; note = 2'-O-methyladenosine-3'-phosphate
  modified_base 4: mod_base = OTHER; note = 2'-O-methyladenosine-3'-phosphate
  modified_base 5: mod_base = OTHER; note = 2'-O-methyluridine-3'-phosphate
  modified_base 6: mod_base = OTHER; note = 2'-O-methyladenosine-3'-phosphate
  modified_base 7: mod_base = OTHER; note = 2'-O-methylcytidine-3'-phosphate
  modified_base 8: mod_base = OTHER; note = 2'-O-methyluridine-3'-phosphate
  modified_base 9: mod_base = OTHER; note = 2'-O-methylguanosine-3'-phosphate
  modified_base 11: mod_base = OTHER; note = 2'-O-methylcytidine-3'-phosphate
  modified_base 12: mod_base = OTHER; note = 2'-O-methylcytidine-3'-phosphate
  modified_base 13: mod_base = OTHER; note = 2'-O-methylcytidine-3'-phosphate
  modified_base 14: mod_base = OTHER; note = uridine-3'-phosphate
  modified_base 15: mod_base = OTHER; note = 2'-O-methyluridine-3'-phosphate
  modified_base 16: mod_base = OTHER; note = 2'-O-methyluridine-3'-phosphate
  modified_base 17: mod_base = OTHER; note = 2'-O-methyluridine-3'-phosphate
  modified_base 18: mod_base = OTHER; note = 2'-O-methyladenosine-3'-phosphate
  modified_base 19: mod_base = OTHER; note = 2'-O-methyladenosine-3'-phosphate
  modified_base 20: mod_base = OTHER; note = 2'-O-methylguanosine-3'-phosphate
  modified_base 21: mod_base = OTHER; note = 2'-O-methylcytidine-3'-phosphorothioate
  modified_base 22: mod_base = OTHER; note = 2'-O-methyladenosine-3'-phosphorothioate
  modified_base 23: mod_base = OTHER; note = 2'-O-methyladenosine
  misc_feature 1: note = RNA
  misc_feature 3..9: note = RNA
  misc_feature 11..23: note = RNA
  misc_feature 2: note = DNA
  misc_feature 10: note = DNA
agaatactgtcccttttaagcaa

SEQ ID NO: 138 - RNA, 23 nt, synthetic construct
  source 1..23: mol_type = other RNA
  modified_base 1: mod_base = OTHER; note = 2'-O-methyluridine-3'-phosphorothioate
  modified_base 2: mod_base = OTHER; note = 2'-deoxy-2'-fluorocytidine-3'-phosphorothioate
  modified_base 3: mod_base = OTHER; note = 2'-O-methyluridine-3'-phosphate
  modified_base 4: mod_base = OTHER; note = 2'-deoxy-2'-fluorouridine-3'-phosphate
  modified_base 5: mod_base = OTHER; note = 2'-O-methylguanosine-3'-phosphate
  modified_base 6: mod_base = OTHER; note = 2'-deoxy-2'-fluoroguanosine-3'-phosphate
  modified_base 7: mod_base = OTHER; note = 2'-O-methyluridine-3'-phosphate
  modified_base 8: mod_base = OTHER; note = 2'-deoxy-2'-fluorouridine-3'-phosphate
  modified_base 9: mod_base = OTHER; note = 2'-O-methyladenosine-3'-phosphate
  modified_base 10: mod_base = OTHER; note = 2'-deoxy-2'-fluorocytidine-3'-phosphate
  modified_base 11: mod_base = OTHER; note = 2'-O-methyladenosine-3'-phosphate
  modified_base 12: mod_base = OTHER; note = 2'-O-methyluridine-3'-phosphate
  modified_base 13: mod_base = OTHER; note = 2'-O-methylguanosine-3'-phosphate
  modified_base 14: mod_base = OTHER; note = 2'-deoxy-2'-fluoroadenosine-3'-phosphate
  modified_base 15: mod_base = OTHER; note = 2'-O-methyladenosine-3'-phosphate
  modified_base 16: mod_base = OTHER; note = 2'-deoxy-2'-fluoroadenosine-3'-phosphate
  modified_base 17: mod_base = OTHER; note = 2'-O-methyluridine-3'-phosphate
  modified_base 18: mod_base = OTHER; note = 2'-deoxy-2'-fluorocytidine-3'-phosphate
  modified_base 19: mod_base = OTHER; note = 2'-O-methylcytidine-3'-phosphate
  modified_base 20: mod_base = OTHER; note = 2'-deoxy-2'-fluorocytidine-3'-phosphate
  modified_base 21: mod_base = OTHER; note = 2'-O-methyladenosine-3'-phosphorothioate
  modified_base 22: mod_base = OTHER; note = 2'-O-methyluridine-3'-phosphorothioate
  modified_base 23: mod_base = OTHER; note = 2'-O-methylcytidine
tcttggttacatgaaatcccatc

SEQ ID NO: 139 - DNA, 23 bp, synthetic construct
  source 1..23: mol_type = other DNA
  modified_base 1: mod_base = OTHER; note = 2'-O-methyluridine-3'-phosphorothioate
  modified_base 2: mod_base = OTHER; note = 2'-deoxycytidine-3'-phosphorothioate
  modified_base 3: mod_base = OTHER; note = 2'-O-methyluridine-3'-phosphate
  modified_base 4: mod_base = OTHER; note = 2'-O-methyluridine-3'-phosphate
  modified_base 5: mod_base = OTHER; note = 2'-O-methylguanosine-3'-phosphate
  modified_base 6: mod_base = OTHER; note = 2'-O-methylguanosine-3'-phosphate
  modified_base 7: mod_base = OTHER; note = 2'-O-methyluridine-3'-phosphate
  modified_base 8: mod_base = OTHER; note = 2'-O-methyluridine-3'-phosphate
  modified_base 9: mod_base = OTHER; note = 2'-O-methyladenosine-3'-phosphate
  modified_base 11: mod_base = OTHER; note = 2'-O-methyladenosine-3'-phosphate
  modified_base 12: mod_base = OTHER; note = 2'-O-methyluridine-3'-phosphate
  modified_base 13: mod_base = OTHER; note = 2'-O-methylguanosine-3'-phosphate
  modified_base 15: mod_base = OTHER; note = 2'-O-methyladenosine-3'-phosphate
  modified_base 16: mod_base = OTHER; note = 2'-O-methyladenosine-3'-phosphate
  modified_base 17: mod_base = OTHER; note = 2'-O-methyluridine-3'-phosphate
  modified_base 18: mod_base = OTHER; note = 2'-O-methylcytidine-3'-phosphate
  modified_base 19: mod_base = OTHER; note = 2'-O-methylcytidine-3'-phosphate
  modified_base 20: mod_base = OTHER; note = 2'-O-methylcytidine-3'-phosphate
  modified_base 21: mod_base = OTHER; note = 2'-O-methyladenosine-3'-phosphorothioate
  modified_base 22: mod_base = OTHER; note = 2'-O-methyluridine-3'-phosphorothioate
  modified_base 23: mod_base = OTHER; note = 2'-O-methylcytidine
  misc_feature 1: note = RNA
  misc_feature 3..9: note = RNA
  misc_feature 11..13: note = RNA
  misc_feature 15..23: note = RNA
  misc_feature 2: note = DNA
  misc_feature 10: note = DNA
  misc_feature 14: note = DNA
tcttggttacatgaaatcccatc

SEQ ID NO: 140 - DNA, 23 bp, synthetic construct
  source 1..23: mol_type = other DNA
  modified_base 1: mod_base = OTHER; note = 2'-O-methyluridine-3'-phosphorothioate
  modified_base 2: mod_base = OTHER; note = 2'-deoxycytidine-3'-phosphorothioate
  modified_base 3: mod_base = OTHER; note = 2'-O-methyluridine-3'-phosphate
  modified_base 4: mod_base = OTHER; note = 2'-O-methyluridine-3'-phosphate
  modified_base 5: mod_base = OTHER; note = 2'-O-methylguanosine-3'-phosphate
  modified_base 6: mod_base = OTHER; note = 2'-O-methylguanosine-3'-phosphate
  modified_base 7: mod_base = OTHER; note = 2'-O-methyluridine-3'-phosphate
  modified_base 8: mod_base = OTHER; note = 2'-O-methyluridine-3'-phosphate
  modified_base 9: mod_base = OTHER; note = 2'-O-methyladenosine-3'-phosphate
  modified_base 11: mod_base = OTHER; note = 2'-O-methyladenosine-3'-phosphate
  modified_base 12: mod_base = OTHER; note = 2'-O-methyluridine-3'-phosphate
  modified_base 13: mod_base = OTHER; note = 2'-O-methylguanosine-3'-phosphate
  modified_base 14: mod_base = OTHER; note = adenosine-3'-phosphate
  modified_base 15: mod_base = OTHER; note = 2'-O-methyladenosine-3'-phosphate
  modified_base 16: mod_base = OTHER; note = 2'-O-methyladenosine-3'-phosphate
  modified_base 17: mod_base = OTHER; note = 2'-O-methyluridine-3'-phosphate
  modified_base 18: mod_base = OTHER; note = 2'-O-methylcytidine-3'-phosphate
  modified_base 19: mod_base = OTHER; note = 2'-O-methylcytidine-3'-phosphate
  modified_base 20: mod_base = OTHER; note = 2'-O-methylcytidine-3'-phosphate
  modified_base 21: mod_base = OTHER; note = 2'-O-methyladenosine-3'-phosphorothioate
  modified_base 22: mod_base = OTHER; note = 2'-O-methyluridine-3'-phosphorothioate
  modified_base 23: mod_base = OTHER; note = 2'-O-methylcytidine
  misc_feature 1: note = RNA
  misc_feature 3..9: note = RNA
  misc_feature 11..23: note = RNA
  misc_feature 2: note = DNA
  misc_feature 10: note = DNA
tcttggttacatgaaatcccatc

SEQ ID NO: 141 - DNA, 23 bp, synthetic construct
  source 1..23: mol_type = other DNA
  modified_base 1: mod_base = OTHER; note = 2'-O-methyluridine-3'-phosphorothioate
  modified_base 2: mod_base = OTHER; note = 2'-deoxycytidine-3'-phosphorothioate
  modified_base 3: mod_base = OTHER; note = 2'-O-methyluridine-3'-phosphate
  modified_base 4: mod_base = OTHER; note = 2'-O-methyluridine-3'-phosphate
  modified_base 5: mod_base = OTHER; note = 2'-O-methylguanosine-3'-phosphate
  modified_base 6: mod_base = OTHER; note = 2'-O-methylguanosine-3'-phosphate
  modified_base 7: mod_base = OTHER; note = 2'-O-methyluridine-3'-phosphate
  modified_base 8: mod_base = OTHER; note = 2'-O-methyluridine-3'-phosphate
  modified_base 9: mod_base = OTHER; note = 2'-O-methyladenosine-3'-phosphate
  modified_base 11: mod_base = OTHER; note = 2'-O-methyladenosine-3'-phosphate
  modified_base 12: mod_base = OTHER; note = 2'-O-methyluridine-3'-phosphate
  modified_base 13: mod_base = OTHER; note = 2'-O-methylguanosine-3'-phosphate
  modified_base 15: mod_base = OTHER; note = 2'-O-methyladenosine-3'-phosphate
  modified_base 16: mod_base = OTHER; note = 2'-O-methyladenosine-3'-phosphate
  modified_base 17: mod_base = OTHER; note = 2'-O-methyluridine-3'-phosphate
  modified_base 18: mod_base = OTHER; note = 2'-O-methylcytidine-3'-phosphate
  modified_base 19: mod_base = OTHER; note = 2'-O-methylcytidine-3'-phosphate
  modified_base 20: mod_base = OTHER; note = 2'-O-methylcytidine-3'-phosphate
  modified_base 21: mod_base = OTHER; note = 2'-O-methyladenosine-3'-phosphorothioate
  modified_base 22: mod_base = OTHER; note = 2'-O-methyluridine-3'-phosphorothioate
  modified_base 23: mod_base = OTHER; note = 2'-O-methylcytidine
  misc_feature 1: note = RNA
  misc_feature 3..9: note = RNA
  misc_feature 11..13: note = RNA
  misc_feature 15..23: note = RNA
  misc_feature 2: note = DNA
  misc_feature 10: note = DNA
  misc_feature 14: note = DNA
tcttggttacatgaaatcccatc

SEQ ID NO: 142 - DNA, 23 bp, synthetic construct
  source 1..23: mol_type = other DNA
  modified_base 1: mod_base = OTHER; note = 2'-O-methyluridine-3'-phosphorothioate
  modified_base 2: mod_base = OTHER; note = 2'-deoxycytidine-3'-phosphorothioate
  modified_base 3: mod_base = OTHER; note = 2'-O-methyluridine-3'-phosphate
  modified_base 4: mod_base = OTHER; note = 2'-O-methyluridine-3'-phosphate
  modified_base 5: mod_base = OTHER; note = 2'-O-methylguanosine-3'-phosphate
  modified_base 6: mod_base = OTHER; note = 2'-O-methylguanosine-3'-phosphate
  modified_base 7: mod_base = OTHER; note = 2'-O-methyluridine-3'-phosphate
  modified_base 8: mod_base = OTHER; note = 2'-O-methyluridine-3'-phosphate
  modified_base 9: mod_base = OTHER; note = 2'-O-methyladenosine-3'-phosphate
  modified_base 11: mod_base = OTHER; note = 2'-O-methyladenosine-3'-phosphate
  modified_base 12: mod_base = OTHER; note = 2'-O-methyluridine-3'-phosphate
  modified_base 13: mod_base = OTHER; note = 2'-O-methylguanosine-3'-phosphate
  modified_base 14: mod_base = OTHER; note = adenosine-3'-phosphate
  modified_base 15: mod_base = OTHER; note = 2'-O-methyladenosine-3'-phosphate
  modified_base 16: mod_base = OTHER; note = 2'-O-methyladenosine-3'-phosphate
  modified_base 17: mod_base = OTHER; note = 2'-O-methyluridine-3'-phosphate
  modified_base 18: mod_base = OTHER; note = 2'-O-methylcytidine-3'-phosphate
  modified_base 19: mod_base = OTHER; note = 2'-O-methylcytidine-3'-phosphate
  modified_base 20: mod_base = OTHER; note = 2'-O-methylcytidine-3'-phosphate
  modified_base 21: mod_base = OTHER; note = 2'-O-methyladenosine-3'-phosphorothioate
  modified_base 22: mod_base = OTHER; note = 2'-O-methyluridine-3'-phosphorothioate
  modified_base 23: mod_base = OTHER; note = 2'-O-methylcytidine
  misc_feature 1: note = RNA
  misc_feature 3..9: note = RNA
  misc_feature 11..23: note = RNA
  misc_feature 2: note = DNA
  misc_feature 10: note = DNA
tcttggttacatgaaatcccatc

SEQ ID NO: 143 - RNA, 21 nt, synthetic construct
  source 1..21: mol_type = other RNA
  modified_base 1: mod_base = OTHER; note = 2'-deoxy-2'-fluoroadenosine-3'-phosphorothioate
  modified_base 2: mod_base = OTHER; note = 2'-O-methyladenosine-3'-phosphorothioate
  modified_base 3: mod_base = OTHER; note = 2'-deoxy-2'-fluorocytidine-3'-phosphate
  modified_base 4: mod_base = OTHER; note = 2'-O-methyladenosine-3'-phosphate
  modified_base 5: mod_base = OTHER; note = 2'-deoxy-2'-fluoroguanosine-3'-phosphate
  modified_base 6: mod_base = OTHER; note = 2'-O-methyluridine-3'-phosphate
  modified_base 7: mod_base = OTHER; note = 2'-deoxy-2'-fluoroguanosine-3'-phosphate
  modified_base 8: mod_base = OTHER; note = 2'-O-methyluridine-3'-phosphate
  modified_base 9: mod_base = OTHER; note = 2'-deoxy-2'-fluorouridine-3'-phosphate
  modified_base 10: mod_base = OTHER; note = 2'-deoxy-2'-fluorocytidine-3'-phosphate
  modified_base 11: mod_base = OTHER; note = 2'-deoxy-2'-fluorouridine-3'-phosphate
  modified_base 12: mod_base = OTHER; note = 2'-O-methyluridine-3'-phosphate
  modified_base 13: mod_base = OTHER; note = 2'-deoxy-2'-fluoroguanosine-3'-phosphate
  modified_base 14: mod_base = OTHER; note = 2'-O-methylcytidine-3'-phosphate
  modified_base 15: mod_base = OTHER; note = 2'-deoxy-2'-fluorouridine-3'-phosphate
  modified_base 16: mod_base = OTHER; note = 2'-O-methylcytidine-3'-phosphate
  modified_base 17: mod_base = OTHER; note = 2'-deoxy-2'-fluorouridine-3'-phosphate
  modified_base 18: mod_base = OTHER; note = 2'-O-methyladenosine-3'-phosphate
  modified_base 19: mod_base = OTHER; note = 2'-deoxy-2'-fluorouridine-3'-phosphate
  modified_base 20: mod_base = OTHER; note = 2'-O-methyladenosine-3'-phosphate
  modified_base 21: mod_base = OTHER; note = 2'-deoxy-2'-fluoroadenosine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
aacagtgttcttgctctataa

SEQ ID NO: 144 - DNA, 21 bp, synthetic construct
  source 1..21: mol_type = other DNA
  modified_base 1: mod_base = OTHER; note = 2'-O-methyladenosine-3'-phosphorothioate
  modified_base 2: mod_base = OTHER; note = 2'-O-methyladenosine-3'-phosphorothioate
  modified_base 3: mod_base = OTHER; note = 2'-O-methylcytidine-3'-phosphate
  modified_base 4: mod_base = OTHER; note = 2'-O-methyladenosine-3'-phosphate
  modified_base 5: mod_base = OTHER; note = 2'-O-methylguanosine-3'-phosphate
  modified_base 6: mod_base = OTHER; note = 2'-O-methyluridine-3'-phosphate
  modified_base 7: mod_base = OTHER; note = 2'-O-methylguanosine-3'-phosphate
  modified_base 8: mod_base = OTHER; note = 2'-O-methyluridine-3'-phosphate
  modified_base 9: mod_base = OTHER; note = 2'-O-methyluridine-3'-phosphate
  modified_base 10: mod_base = OTHER; note = 2'-O-methylcytidine-3'-phosphate
  modified_base 12: mod_base = OTHER; note = 2'-O-methyluridine-3'-phosphate
  modified_base 13: mod_base = OTHER; note = 2'-O-methylguanosine-3'-phosphate
  modified_base 14: mod_base = OTHER; note = 2'-O-methylcytidine-3'-phosphate
  modified_base 15: mod_base = OTHER; note = 2'-O-methyluridine-3'-phosphate
  modified_base 16: mod_base = OTHER; note = 2'-O-methylcytidine-3'-phosphate
  modified_base 17: mod_base = OTHER; note = Thymidine-glycol nucleic acid (GNA), S-Isomer
  modified_base 18: mod_base = OTHER; note = 2'-O-methyladenosine-3'-phosphate
  modified_base 19: mod_base = OTHER; note = 2'-O-methyluridine-3'-phosphate
  modified_base 20: mod_base = OTHER; note = 2'-O-methyladenosine-3'-phosphate
  modified_base 21: mod_base = OTHER; note = 2'-O-methyladenosine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
  misc_feature 1..10: note = RNA
  misc_feature 12..21: note = RNA
  misc_feature 11: note = DNA
aacagtgttcttgctctataa

SEQ ID NO: 145 - DNA, 21 bp, synthetic construct
  source 1..21: mol_type = other DNA
  modified_base 1: mod_base = OTHER; note = 2'-O-methyladenosine-3'-phosphorothioate
  modified_base 2: mod_base = OTHER; note = 2'-O-methyladenosine-3'-phosphorothioate
  modified_base 3: mod_base = OTHER; note = 2'-O-methylcytidine-3'-phosphate
  modified_base 4: mod_base = OTHER; note = 2'-O-methyladenosine-3'-phosphate
  modified_base 5: mod_base = OTHER; note = 2'-O-methylguanosine-3'-phosphate
  modified_base 6: mod_base = OTHER; note = 2'-O-methyluridine-3'-phosphate
  modified_base 7: mod_base = OTHER; note = 2'-O-methylguanosine-3'-phosphate
  modified_base 8: mod_base = OTHER; note = 2'-O-methyluridine-3'-phosphate
  modified_base 9: mod_base = OTHER; note = 2'-O-methyluridine-3'-phosphate
  modified_base 10: mod_base = OTHER; note = 2'-O-methylcytidine-3'-phosphate
  modified_base 12: mod_base = OTHER; note = 2'-O-methyluridine-3'-phosphate
  modified_base 13: mod_base = OTHER; note = 2'-O-methylguanosine-3'-phosphate
  modified_base 14: mod_base = OTHER; note = 2'-O-methylcytidine-3'-phosphate
  modified_base 15: mod_base = OTHER; note = 2'-O-methyluridine-3'-phosphate
  modified_base 16: mod_base = OTHER; note = 2'-O-methylcytidine-3'-phosphate
  modified_base 17: mod_base = OTHER; note = Thymidine-glycol nucleic acid (GNA), S-Isomer
  modified_base 18: mod_base = OTHER; note = 2'-O-methyladenosine-3'-phosphate
  modified_base 19: mod_base = OTHER; note = 2'-O-methyluridine-3'-phosphate
  modified_base 20: mod_base = OTHER; note = 2'-O-methyladenosine-3'-phosphate
  modified_base 21: mod_base = OTHER; note = 2'-O-methyladenosine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
  misc_feature 1..10: note = RNA
  misc_feature 12..21: note = RNA
  misc_feature 11: note = DNA
aacagtgttcttgctctataa

SEQ ID NO: 146 - RNA, 23 nt, synthetic construct
  source 1..23: mol_type = other RNA
  modified_base 1: mod_base = OTHER; note = 2'-O-methyluridine-3'-phosphorothioate
  modified_base 2: mod_base = OTHER; note = 2'-deoxy-2'-fluorouridine-3'-phosphorothioate
  modified_base 3: mod_base = OTHER; note = 2'-O-methyladenosine-3'-phosphate
  modified_base 4: mod_base = OTHER; note = 2'-deoxy-2'-fluorouridine-3'-phosphate
  modified_base 5: mod_base = OTHER; note = 2'-O-methyladenosine-3'-phosphate
  modified_base 6: mod_base = OTHER; note = 2'-deoxy-2'-fluoroguanosine-3'-phosphate
  modified_base 7: mod_base = OTHER; note = 2'-O-methyladenosine-3'-phosphate
  modified_base 8: mod_base = OTHER; note = 2'-deoxy-2'-fluoroguanosine-3'-phosphate
  modified_base 9: mod_base = OTHER; note = 2'-O-methylcytidine-3'-phosphate
  modified_base 10: mod_base = OTHER; note = 2'-deoxy-2'-fluoroadenosine-3'-phosphate
  modified_base 11: mod_base = OTHER; note = 2'-O-methyladenosine-3'-phosphate
  modified_base 12: mod_base = OTHER; note = 2'-O-methylguanosine-3'-phosphate
  modified_base 13: mod_base = OTHER; note = 2'-O-methyladenosine-3'-phosphate
  modified_base 14: mod_base = OTHER; note = 2'-deoxy-2'-fluoroadenosine-3'-phosphate
  modified_base 15: mod_base = OTHER; note = 2'-O-methylcytidine-3'-phosphate
  modified_base 16: mod_base = OTHER; note = 2'-deoxy-2'-fluoroadenosine-3'-phosphate
  modified_base 17: mod_base = OTHER; note = 2'-O-methylcytidine-3'-phosphate
  modified_base 18: mod_base = OTHER; note = 2'-deoxy-2'-fluorouridine-3'-phosphate
  modified_base 19: mod_base = OTHER; note = 2'-O-methylguanosine-3'-phosphate
  modified_base 20: mod_base = OTHER; note = 2'-deoxy-2'-fluorouridine-3'-phosphate
  modified_base 21: mod_base = OTHER; note = 2'-O-methyluridine-3'-phosphorothioate
  modified_base 22: mod_base = OTHER; note = 2'-O-methyluridine-3'-phosphorothioate
  modified_base 23: mod_base = OTHER; note = 2'-O-methyluridine
ttatagagcaagaacactgtttt

SEQ ID NO: 147 - DNA, 23 bp, synthetic construct
  source 1..23: mol_type = other DNA
  modified_base 1: mod_base = OTHER; note = 2'-O-methyluridine-3'-phosphorothioate
  modified_base 2: mod_base = OTHER; note = 2'-deoxythymidine-3'-phosphorothioate
  modified_base 3: mod_base = OTHER; note = 2'-O-methyladenosine-3'-phosphate
  modified_base 4: mod_base = OTHER; note = 2'-O-methyluridine-3'-phosphate
  modified_base 5: mod_base = OTHER; note = 2'-O-methyladenosine-3'-phosphate
  modified_base 6: mod_base = OTHER; note = 2'-O-methylguanosine-3'-phosphate
  modified_base 7: mod_base = OTHER; note = 2'-O-methyladenosine-3'-phosphate
  modified_base 8: mod_base = OTHER; note = 2'-O-methylguanosine-3'-phosphate
  modified_base 9: mod_base = OTHER; note = 2'-O-methylcytidine-3'-phosphate
  modified_base 11: mod_base = OTHER; note = 2'-O-methyladenosine-3'-phosphate
  modified_base 12: mod_base = OTHER; note = 2'-O-methylguanosine-3'-phosphate
  modified_base 13: mod_base = OTHER; note = 2'-O-methyladenosine-3'-phosphate
  modified_base 15: mod_base = OTHER; note = 2'-O-methylcytidine-3'-phosphate
  modified_base 16: mod_base = OTHER; note = 2'-O-methyladenosine-3'-phosphate
  modified_base 17: mod_base = OTHER; note = 2'-O-methylcytidine-3'-phosphate
  modified_base 18: mod_base = OTHER; note = 2'-O-methyluridine-3'-phosphate
  modified_base 19: mod_base = OTHER; note = 2'-O-methylguanosine-3'-phosphate
  modified_base 20: mod_base = OTHER; note = 2'-O-methyluridine-3'-phosphate
  modified_base 21: mod_base = OTHER; note = 2'-O-methyluridine-3'-phosphorothioate
  modified_base 22: mod_base = OTHER; note = 2'-O-methyluridine-3'-phosphorothioate
  modified_base 23: mod_base = OTHER; note = 2'-O-methyluridine
  misc_feature 1: note = RNA
  misc_feature 3..9: note = RNA
  misc_feature 11..13: note = RNA
  misc_feature 15..23: note = RNA
  misc_feature 2: note = DNA
  misc_feature 10: note = DNA
  misc_feature 14: note = DNA
ttatagagcaagaacactgtttt

SEQ ID NO: 148 - DNA, 23 bp, synthetic construct
  source 1..23: mol_type = other DNA
  modified_base 1: mod_base = OTHER; note = 2'-O-methyluridine-3'-phosphorothioate
  modified_base 2: mod_base = OTHER; note = 2'-deoxythymidine-3'-phosphorothioate
  modified_base 3: mod_base = OTHER; note = 2'-O-methyladenosine-3'-phosphate
  modified_base 4: mod_base = OTHER; note = 2'-O-methyluridine-3'-phosphate
  modified_base 5: mod_base = OTHER; note = 2'-O-methyladenosine-3'-phosphate
  modified_base 6: mod_base = OTHER; note = 2'-O-methylguanosine-3'-phosphate
  modified_base 7: mod_base = OTHER; note = 2'-O-methyladenosine-3'-phosphate
  modified_base 8: mod_base = OTHER; note = 2'-O-methylguanosine-3'-phosphate
  modified_base 9: mod_base = OTHER; note = 2'-O-methylcytidine-3'-phosphate
  modified_base 11: mod_base = OTHER; note = 2'-O-methyladenosine-3'-phosphate
  modified_base 12: mod_base = OTHER; note = 2'-O-methylguanosine-3'-phosphate
  modified_base 13: mod_base = OTHER; note = 2'-O-methyladenosine-3'-phosphate
  modified_base 14: mod_base = OTHER; note = adenosine-3'-phosphate
  modified_base 15: mod_base = OTHER; note = 2'-O-methylcytidine-3'-phosphate
  modified_base 16: mod_base = OTHER; note = 2'-O-methyladenosine-3'-phosphate
  modified_base 17: mod_base = OTHER; note = 2'-O-methylcytidine-3'-phosphate
  modified_base 18: mod_base = OTHER; note = 2'-O-methyluridine-3'-phosphate
  modified_base 19: mod_base = OTHER; note = 2'-O-methylguanosine-3'-phosphate
  modified_base 20: mod_base = OTHER; note = 2'-O-methyluridine-3'-phosphate
  modified_base 21: mod_base = OTHER; note = 2'-O-methyluridine-3'-phosphorothioate
  modified_base 22: mod_base = OTHER; note = 2'-O-methyluridine-3'-phosphorothioate
  modified_base 23: mod_base = OTHER; note = 2'-O-methyluridine
  misc_feature 1: note = RNA
  misc_feature 3..9: note = RNA
  misc_feature 11..23: note = RNA
  misc_feature 2: note = DNA
  misc_feature 10: note = DNA
ttatagagcaagaacactgtttt

SEQ ID NO: 149 - RNA, 21 nt, synthetic construct
  source 1..21: mol_type = other RNA
  modified_base 1: mod_base = OTHER; note = 2'-deoxy-2'-fluorocytidine-3'-phosphorothioate
  modified_base 2: mod_base = OTHER; note = 2'-O-methyluridine-3'-phosphorothioate
  modified_base 3: mod_base = OTHER; note = 2'-deoxy-2'-fluoroguanosine-3'-phosphate
  modified_base 4: mod_base = OTHER; note = 2'-O-methylguanosine-3'-phosphate
  modified_base 5: mod_base = OTHER; note = 2'-deoxy-2'-fluorouridine-3'-phosphate
  modified_base 6: mod_base = OTHER; note = 2'-O-methyladenosine-3'-phosphate
  modified_base 7: mod_base = OTHER; note = 2'-deoxy-2'-fluorouridine-3'-phosphate
  modified_base 8: mod_base = OTHER; note = 2'-O-methyluridine-3'-phosphate
  modified_base 9: mod_base = OTHER; note = 2'-deoxy-2'-fluorouridine-3'-phosphate
  modified_base 10: mod_base = OTHER; note = 2'-deoxy-2'-fluorocytidine-3'-phosphate
  modified_base 11: mod_base = OTHER; note = 2'-deoxy-2'-fluorocytidine-3'-phosphate
  modified_base 12: mod_base = OTHER; note = 2'-O-methyluridine-3'-phosphate
  modified_base 13: mod_base = OTHER; note = 2'-deoxy-2'-fluoroadenosine-3'-phosphate
  modified_base 14: mod_base = OTHER; note = 2'-O-methylguanosine-3'-phosphate
  modified_base 15: mod_base = OTHER; note = 2'-deoxy-2'-fluoroguanosine-3'-phosphate
  modified_base 16: mod_base = OTHER; note = 2'-O-methylguanosine-3'-phosphate
  modified_base 17: mod_base = OTHER; note = 2'-deoxy-2'-fluorouridine-3'-phosphate
  modified_base 18: mod_base = OTHER; note = 2'-O-methyladenosine-3'-phosphate
  modified_base 19: mod_base = OTHER; note = 2'-deoxy-2'-fluorocytidine-3'-phosphate
  modified_base 20: mod_base = OTHER; note = 2'-O-methyladenosine-3'-phosphate
  modified_base 21: mod_base = OTHER; note = 2'-deoxy-2'-fluoroadenosine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
ctggtatttcctagggtacaa

SEQ ID NO: 150 - DNA, 21 bp, synthetic construct
  source 1..21: mol_type = other DNA
  modified_base 1: mod_base = OTHER; note = 2'-O-methylcytidine-3'-phosphorothioate
  modified_base 2: mod_base = OTHER; note = 2'-O-methyluridine-3'-phosphorothioate
  modified_base 3: mod_base = OTHER; note = 2'-O-methylguanosine-3'-phosphate
  modified_base 4: mod_base = OTHER; note = 2'-O-methylguanosine-3'-phosphate
  modified_base 5: mod_base = OTHER; note = 2'-O-methyluridine-3'-phosphate
  modified_base 6: mod_base = OTHER; note = 2'-O-methyladenosine-3'-phosphate
  modified_base 8: mod_base = OTHER; note = 2'-O-methyluridine-3'-phosphate
  modified_base 9: mod_base = OTHER; note = 2'-O-methyluridine-3'-phosphate
  modified_base 10: mod_base = OTHER; note = 2'-O-methylcytidine-3'-phosphate
  modified_base 12: mod_base = OTHER; note = 2'-O-methyluridine-3'-phosphate
  modified_base 13: mod_base = OTHER; note = 2'-O-methyladenosine-3'-phosphate
  modified_base 14: mod_base = OTHER; note = 2'-O-methylguanosine-3'-phosphate
  modified_base 15: mod_base = OTHER; note = 2'-O-methylguanosine-3'-phosphate
  modified_base 16: mod_base = OTHER; note = 2'-O-methylguanosine-3'-phosphate
  modified_base 17: mod_base = OTHER; note = Thymidine-glycol nucleic acid (GNA), S-Isomer
  modified_base 18: mod_base = OTHER; note = 2'-O-methyladenosine-3'-phosphate
  modified_base 19: mod_base = OTHER; note = 2'-O-methylcytidine-3'-phosphate
  modified_base 20: mod_base = OTHER; note = 2'-O-methyladenosine-3'-phosphate
  modified_base 21: mod_base = OTHER; note = 2'-O-methyladenosine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
  misc_feature 1..6: note = RNA
  misc_feature 8..10: note = RNA
  misc_feature 12..21: note = RNA
  misc_feature 7: note = DNA
  misc_feature 11: note = DNA
ctggtatttcctagggtacaa

SEQ ID NO: 151 - DNA, 21 bp, synthetic construct
  source 1..21: mol_type = other DNA
  modified_base 1: mod_base = OTHER; note = 2'-O-methylcytidine-3'-phosphorothioate
  modified_base 2: mod_base = OTHER; note = 2'-O-methyluridine-3'-phosphorothioate
  modified_base 3: mod_base = OTHER; note = 2'-O-methylguanosine-3'-phosphate
  modified_base 4: mod_base = OTHER; note = 2'-O-methylguanosine-3'-phosphate
  modified_base 5: mod_base = OTHER; note = 2'-O-methyluridine-3'-phosphate
  modified_base 7: mod_base = OTHER; note = 2'-O-methyluridine-3'-phosphate
  modified_base 8: mod_base = OTHER; note = 2'-O-methyluridine-3'-phosphate
  modified_base 9: mod_base = OTHER; note = 2'-O-methyluridine-3'-phosphate
  modified_base 10: mod_base = OTHER; note = 2'-O-methylcytidine-3'-phosphate
  modified_base 12: mod_base = OTHER; note = 2'-O-methyluridine-3'-phosphate
  modified_base 13: mod_base = OTHER; note = 2'-O-methyladenosine-3'-phosphate
  modified_base 14: mod_base = OTHER; note = 2'-O-methylguanosine-3'-phosphate
  modified_base 15: mod_base = OTHER; note = 2'-O-methylguanosine-3'-phosphate
  modified_base 16: mod_base = OTHER; note = 2'-O-methylguanosine-3'-phosphate
  modified_base 17: mod_base = OTHER; note = Thymidine-glycol nucleic acid (GNA), S-Isomer
  modified_base 18: mod_base = OTHER; note = 2'-O-methyladenosine-3'-phosphate
  modified_base 19: mod_base = OTHER; note = 2'-O-methylcytidine-3'-phosphate
  modified_base 20: mod_base = OTHER; note = 2'-O-methyladenosine-3'-phosphate
  modified_base 21: mod_base = OTHER; note = 2'-O-methyladenosine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
  misc_feature 1..5: note = RNA
  misc_feature 7..10: note = RNA
  misc_feature 12..21: note = RNA
  misc_feature 6: note = DNA
  misc_feature 11: note = DNA
ctggtatttcctagggtacaa

SEQ ID NO: 152 - DNA, 21 bp, synthetic construct
  source 1..21: mol_type = other DNA
  modified_base 1: mod_base = OTHER; note = 2'-O-methylcytidine-3'-phosphorothioate
  modified_base 2: mod_base = OTHER; note = 2'-O-methyluridine-3'-phosphorothioate
  modified_base 3: mod_base = OTHER; note = 2'-O-methylguanosine-3'-phosphate
  modified_base 4: mod_base = OTHER; note = 2'-O-methylguanosine-3'-phosphate
  modified_base 5: mod_base = OTHER; note = 2'-O-methyluridine-3'-phosphate
  modified_base 6: mod_base = OTHER; note = 2'-O-methyladenosine-3'-phosphate
  modified_base 7: mod_base = OTHER; note = 2'-O-methyluridine-3'-phosphate
  modified_base 8: mod_base = OTHER; note = 2'-O-methyluridine-3'-phosphate
  modified_base 9: mod_base = OTHER; note = 2'-O-methyluridine-3'-phosphate
  modified_base 10: mod_base = OTHER; note = 2'-O-methylcytidine-3'-phosphate
  modified_base 12: mod_base = OTHER; note = 2'-O-methyluridine-3'-phosphate
  modified_base 13: mod_base = OTHER; note = 2'-O-methyladenosine-3'-phosphate
  modified_base 14: mod_base = OTHER; note = 2'-O-methylguanosine-3'-phosphate
  modified_base 15: mod_base = OTHER; note = 2'-O-methylguanosine-3'-phosphate
  modified_base 16: mod_base = OTHER; note = 2'-O-methylguanosine-3'-phosphate
  modified_base 17: mod_base = OTHER; note = Thymidine-glycol nucleic acid (GNA), S-Isomer
  modified_base 18: mod_base = OTHER; note = 2'-O-methyladenosine-3'-phosphate
  modified_base 19: mod_base = OTHER; note = 2'-O-methylcytidine-3'-phosphate
  modified_base 20: mod_base = OTHER; note = 2'-O-methyladenosine-3'-phosphate
  modified_base 21: mod_base = OTHER; note = 2'-O-methyladenosine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
  misc_feature 1..10: note = RNA
  misc_feature 12..21: note = RNA
  misc_feature 11: note = DNA
ctggtatttcctagggtacaa

SEQ ID NO: 153 - DNA, 21 bp, synthetic construct
  source 1..21: mol_type = other DNA
  modified_base 1: mod_base = OTHER; note = 2'-O-methylcytidine-3'-phosphorothioate
  modified_base 2: mod_base = OTHER; note = 2'-O-methyluridine-3'-phosphorothioate
  modified_base 3: mod_base = OTHER; note = 2'-O-methylguanosine-3'-phosphate
  modified_base 4: mod_base = OTHER; note = 2'-O-methylguanosine-3'-phosphate
  modified_base 5: mod_base = OTHER; note = 2'-O-methyluridine-3'-phosphate
  modified_base 6: mod_base = OTHER; note = 2'-O-methyladenosine-3'-phosphate
  modified_base 8: mod_base = OTHER; note = 2'-O-methyluridine-3'-phosphate
  modified_base 9: mod_base = OTHER; note = 2'-O-methyluridine-3'-phosphate
  modified_base 10: mod_base = OTHER; note = 2'-O-methylcytidine-3'-phosphate
  modified_base 12: mod_base = OTHER; note = 2'-O-methyluridine-3'-phosphate
  modified_base 13: mod_base = OTHER; note = 2'-O-methyladenosine-3'-phosphate
  modified_base 14: mod_base = OTHER; note = 2'-O-methylguanosine-3'-phosphate
  modified_base 15: mod_base = OTHER; note = 2'-O-methylguanosine-3'-phosphate
  modified_base 16: mod_base = OTHER; note = 2'-O-methylguanosine-3'-phosphate
  modified_base 18: mod_base = OTHER; note = 2'-O-methyladenosine-3'-phosphate
  modified_base 19: mod_base = OTHER; note = 2'-O-methylcytidine-3'-phosphate
  modified_base 20: mod_base = OTHER; note = 2'-O-methyladenosine-3'-phosphate
  modified_base 21: mod_base = OTHER; note = 2'-O-methyladenosine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
  misc_feature 1..6: note = RNA
  misc_feature 8..10: note = RNA
  misc_feature 12..16: note = RNA
  misc_feature 18..21: note = RNA
  misc_feature 7: note = DNA
  misc_feature 11: note = DNA
  misc_feature 17: note = DNA
ctggtatttcctagggaacaa

SEQ ID NO: 154 - RNA, 23 nt, synthetic construct
  source 1..23: mol_type = other RNA
  modified_base 1: mod_base = OTHER; note = 2'-O-methyluridine-3'-phosphorothioate
  modified_base 2: mod_base = OTHER; note = 2'-deoxy-2'-fluorouridine-3'-phosphorothioate
  modified_base 3: mod_base = OTHER; note = 2'-O-methylguanosine-3'-phosphate
  modified_base 4: mod_base = OTHER; note = 2'-deoxy-2'-fluorouridine-3'-phosphate
  modified_base 5: mod_base = OTHER; note = 2'-O-methyladenosine-3'-phosphate
  modified_base 6: mod_base = OTHER; note = 2'-deoxy-2'-fluorocytidine-3'-phosphate
  modified_base 7: mod_base = OTHER; note = 2'-O-methylcytidine-3'-phosphate
  modified_base 8: mod_base = OTHER; note = 2'-deoxy-2'-fluorocytidine-3'-phosphate
  modified_base 9: mod_base = OTHER; note = 2'-O-methyluridine-3'-phosphate
  modified_base 10: mod_base = OTHER; note = 2'-deoxy-2'-fluoroadenosine-3'-phosphate
  modified_base 11: mod_base = OTHER; note = 2'-O-methylguanosine-3'-phosphate
  modified_base 12: mod_base = OTHER; note = 2'-O-methylguanosine-3'-phosphate
  modified_base 13: mod_base = OTHER; note = 2'-O-methyladenosine-3'-phosphate
  modified_base 14: mod_base = OTHER; note = 2'-deoxy-2'-fluoroadenosine-3'-phosphate
  modified_base 15: mod_base = OTHER; note = 2'-O-methyladenosine-3'-phosphate
  modified_base 16: mod_base = OTHER; note = 2'-deoxy-2'-fluorouridine-3'-phosphate
  modified_base 17: mod_base = OTHER; note = 2'-O-methyladenosine-3'-phosphate
  modified_base 18: mod_base = OTHER; note = 2'-deoxy-2'-fluorocytidine-3'-phosphate
  modified_base 19: mod_base = OTHER; note = 2'-O-methylcytidine-3'-phosphate
  modified_base 20: mod_base = OTHER; note = 2'-deoxy-2'-fluoroadenosine-3'-phosphate
  modified_base 21: mod_base = OTHER; note = 2'-O-methylguanosine-3'-phosphorothioate
  modified_base 22: mod_base = OTHER; note = 2'-O-methyladenosine-3'-phosphorothioate
  modified_base 23: mod_base = OTHER; note = 2'-O-methylguanosine
ttgtaccctaggaaataccagag

SEQ ID NO: 155 - DNA, 23 bp, synthetic construct
  source 1..23: mol_type = other DNA
  modified_base 1: mod_base = OTHER; note = 2'-O-methyluridine-3'-phosphorothioate
  modified_base 2: mod_base = OTHER; note = uridine-3'-phosphorothioate
  modified_base 3: mod_base = OTHER; note = 2'-O-methylguanosine-3'-phosphate
  modified_base 4: mod_base = OTHER; note = 2'-O-methyluridine-3'-phosphate
  modified_base 5: mod_base = OTHER; note = 2'-O-methyladenosine-3'-phosphate
  modified_base 6: mod_base = OTHER; note = 2'-O-methylcytidine-3'-phosphate
  modified_base 7: mod_base = OTHER; note = 2'-O-methylcytidine-3'-phosphate
  modified_base 8: mod_base = OTHER; note = 2'-O-methylcytidine-3'-phosphate
  modified_base 9: mod_base = OTHER; note = 2'-O-methyluridine-3'-phosphate
  modified_base 11: mod_base = OTHER; note = 2'-O-methylguanosine-3'-phosphate
  modified_base 12: mod_base = OTHER; note = 2'-O-methylguanosine-3'-phosphate
  modified_base 13: mod_base = OTHER; note = 2'-O-methyladenosine-3'-phosphate
  modified_base 15: mod_base = OTHER; note = 2'-O-methyladenosine-3'-phosphate
  modified_base 16: mod_base = OTHER; note = 2'-O-methyluridine-3'-phosphate
  modified_base 17: mod_base = OTHER; note = 2'-O-methyladenosine-3'-phosphate
  modified_base 18: mod_base = OTHER; note = 2'-O-methylcytidine-3'-phosphate
  modified_base 19: mod_base = OTHER; note = 2'-O-methylcytidine-3'-phosphate
  modified_base 20: mod_base = OTHER; note = 2'-O-methyladenosine-3'-phosphate
  modified_base 21: mod_base = OTHER; note = 2'-O-methylguanosine-3'-phosphorothioate
  modified_base 22: mod_base = OTHER; note = 2'-O-methyladenosine-3'-phosphorothioate
  modified_base 23: mod_base = OTHER; note = 2'-O-methylguanosine
  misc_feature 1..9: note = RNA
  misc_feature 11..13: note = RNA
  misc_feature 15..23: note = RNA
  misc_feature 10: note = DNA
  misc_feature 14: note = DNA
ttgtaccctaggaaataccagag

SEQ ID NO: 156 - DNA, 23 bp, synthetic construct
  source 1..23: mol_type = other DNA
  modified_base 1: mod_base = OTHER; note = 2'-O-methyluridine-3'-phosphorothioate
  modified_base 2: mod_base = OTHER; note = 2'-deoxythymidine-3'-phosphorothioate
  modified_base 3: mod_base = OTHER; note = 2'-O-methylguanosine-3'-phosphate
  modified_base 4: mod_base = OTHER; note = 2'-O-methyluridine-3'-phosphate
  modified_base 5: mod_base = OTHER; note = 2'-O-methyladenosine-3'-phosphate
  modified_base 6: mod_base = OTHER; note = 2'-O-methylcytidine-3'-phosphate
  modified_base 7: mod_base = OTHER; note = 2'-O-methylcytidine-3'-phosphate
  modified_base 8: mod_base = OTHER; note = 2'-O-methylcytidine-3'-phosphate
  modified_base 9: mod_base = OTHER; note = 2'-O-methyluridine-3'-phosphate
  modified_base 11: mod_base = OTHER; note = 2'-O-methylguanosine-3'-phosphate
  modified_base 12: mod_base = OTHER; note = 2'-O-methylguanosine-3'-phosphate
  modified_base 13: mod_base = OTHER; note = 2'-O-methyladenosine-3'-phosphate
  modified_base 15: mod_base = OTHER; note = 2'-O-methyladenosine-3'-phosphate
  modified_base 16: mod_base = OTHER; note = 2'-O-methyluridine-3'-phosphate
  modified_base 17: mod_base = OTHER; note = 2'-O-methyladenosine-3'-phosphate
  modified_base 18: mod_base = OTHER; note = 2'-O-methylcytidine-3'-phosphate
  modified_base 19: mod_base = OTHER; note = 2'-O-methylcytidine-3'-phosphate
  modified_base 20: mod_base = OTHER; note = 2'-O-methyladenosine-3'-phosphate
  modified_base 21: mod_base = OTHER; note = 2'-O-methylguanosine-3'-phosphorothioate
  modified_base 22: mod_base = OTHER; note = 2'-O-methyladenosine-3'-phosphorothioate
  modified_base 23: mod_base = OTHER; note = 2'-O-methylguanosine
  misc_feature 1: note = RNA
  misc_feature 3..9: note = RNA
  misc_feature 11..13: note = RNA
  misc_feature 15..23: note = RNA
  misc_feature 2: note = DNA
  misc_feature 10: note = DNA
  misc_feature 14: note = DNA
ttgtaccctaggaaataccagag

SEQ ID NO: 157 - DNA, 23 bp, synthetic construct
  source 1..23: mol_type = other DNA
  modified_base 1: mod_base = OTHER; note = 2'-O-methyluridine-3'-phosphorothioate
  modified_base 2: mod_base = OTHER; note = 2'-deoxythymidine-3'-phosphorothioate
  modified_base 3: mod_base = OTHER; note = 2'-O-methylguanosine-3'-phosphate
  modified_base 4: mod_base = OTHER; note = 2'-O-methyluridine-3'-phosphate
  modified_base 5: mod_base = OTHER; note = 2'-O-methyladenosine-3'-phosphate
  modified_base 6: mod_base = OTHER; note = 2'-O-methylcytidine-3'-phosphate
  modified_base 7: mod_base = OTHER; note = 2'-O-methylcytidine-3'-phosphate
  modified_base 8: mod_base = OTHER; note = 2'-O-methylcytidine-3'-phosphate
  modified_base 9: mod_base = OTHER; note = 2'-O-methyluridine-3'-phosphate
  modified_base 11: mod_base = OTHER; note = 2'-O-methylguanosine-3'-phosphate
  modified_base 12: mod_base = OTHER; note = 2'-O-methylguanosine-3'-phosphate
  modified_base 13: mod_base = OTHER; note = 2'-O-methyladenosine-3'-phosphate
  modified_base 15: mod_base = OTHER; note = 2'-O-methyladenosine-3'-phosphate
  modified_base 16: mod_base = OTHER; note = 2'-O-methyluridine-3'-phosphate
  modified_base 17: mod_base = OTHER; note = 2'-O-methyladenosine-3'-phosphate
  modified_base 18: mod_base = OTHER; note = 2'-O-methylcytidine-3'-phosphate
  modified_base 19: mod_base = OTHER; note = 2'-O-methylcytidine-3'-phosphate
  modified_base 20: mod_base = OTHER; note = 2'-O-methyladenosine-3'-phosphate
  modified_base 21: mod_base = OTHER; note = 2'-O-methylguanosine-3'-phosphorothioate
  modified_base 22: mod_base = OTHER; note = 2'-O-methyladenosine-3'-phosphorothioate
  modified_base 23: mod_base = OTHER; note = 2'-O-methylguanosine
  misc_feature 1: note = RNA
  misc_feature 3..9: note = RNA
  misc_feature 11..13: note = RNA
  misc_feature 15..23: note = RNA
  misc_feature 2: note = DNA
  misc_feature 10: note = DNA
  misc_feature 14: note = DNA
ttgtaccctaggaaataccagag

SEQ ID NO: 158 - DNA, 23 bp, synthetic construct
  source 1..23: mol_type = other DNA
  modified_base 1: mod_base = OTHER; note = 2'-O-methyluridine-3'-phosphorothioate
  modified_base 2: mod_base = OTHER; note = 2'-deoxythymidine-3'-phosphorothioate
  modified_base 3: mod_base = OTHER; note = 2'-O-methylguanosine-3'-phosphate
  modified_base 4: mod_base = OTHER; note = 2'-O-methyluridine-3'-phosphate
  modified_base 5: mod_base = OTHER; note = 2'-O-methyladenosine-3'-phosphate
  modified_base 6: mod_base = OTHER; note = 2'-O-methylcytidine-3'-phosphate
  modified_base 7: mod_base = OTHER; note = 2'-O-methylcytidine-3'-phosphate
  modified_base 8: mod_base = OTHER; note = 2'-O-methylcytidine-3'-phosphate
  modified_base 9: mod_base = OTHER; note = 2'-O-methyluridine-3'-phosphate
  modified_base 11: mod_base = OTHER; note = 2'-O-methylguanosine-3'-phosphate
  modified_base 12: mod_base = OTHER; note = 2'-O-methylguanosine-3'-phosphate
  modified_base 13: mod_base = OTHER; note = 2'-O-methyladenosine-3'-phosphate
  modified_base 15: mod_base = OTHER; note = 2'-O-methyladenosine-3'-phosphate
  modified_base 16: mod_base = OTHER; note = 2'-O-methyluridine-3'-phosphate
  modified_base 17: mod_base = OTHER; note = 2'-O-methyladenosine-3'-phosphate
  modified_base 18: mod_base = OTHER; note = 2'-O-methylcytidine-3'-phosphate
  modified_base 19: mod_base = OTHER; note = 2'-O-methylcytidine-3'-phosphate
  modified_base 20: mod_base = OTHER; note = 2'-O-methyladenosine-3'-phosphate
  modified_base 21: mod_base = OTHER; note = 2'-O-methylguanosine-3'-phosphorothioate
  modified_base 22: mod_base = OTHER; note = 2'-O-methyladenosine-3'-phosphorothioate
  modified_base 23: mod_base = OTHER; note = 2'-O-methylguanosine
  misc_feature 1: note = RNA
  misc_feature 3..9: note = RNA
  misc_feature 11..13: note = RNA
  misc_feature 15..23: note = RNA
  misc_feature 2: note = DNA
  misc_feature 10: note = DNA
  misc_feature 14: note = DNA
ttgtaccctaggaaataccagag

SEQ ID NO: 159 - DNA, 21 bp, synthetic construct
  source 1..21: mol_type = other DNA
  modified_base 1: mod_base = OTHER; note = 2'-O-methylcytidine-3'-phosphorothioate
  modified_base 2: mod_base = OTHER; note = 2'-O-methyluridine-3'-phosphorothioate
  modified_base 3: mod_base = OTHER; note = 2'-O-methylguanosine-3'-phosphate
  modified_base 4: mod_base = OTHER; note = 2'-O-methylguanosine-3'-phosphate
  modified_base 5: mod_base = OTHER; note = 2'-O-methyluridine-3'-phosphate
  modified_base 7: mod_base = OTHER; note = 2'-O-methyluridine-3'-phosphate
  modified_base 8: mod_base = OTHER; note = 2'-O-methyluridine-3'-phosphate
  modified_base 9: mod_base = OTHER; note = 2'-O-methyluridine-3'-phosphate
  modified_base 10: mod_base = OTHER; note = 2'-O-methylcytidine-3'-phosphate
  modified_base 12: mod_base = OTHER; note = 2'-O-methyluridine-3'-phosphate
  modified_base 13: mod_base = OTHER; note = 2'-O-methyladenosine-3'-phosphate
  modified_base 14: mod_base = OTHER; note = 2'-O-methylguanosine-3'-phosphate
  modified_base 15: mod_base = OTHER; note = 2'-O-methylguanosine-3'-phosphate
  modified_base 16: mod_base = OTHER; note = 2'-O-methylguanosine-3'-phosphate
  modified_base 17: mod_base = OTHER; note = Thymidine-glycol nucleic acid (GNA), S-Isomer
  modified_base 18: mod_base = OTHER; note = 2'-O-methyladenosine-3'-phosphate
  modified_base 19: mod_base = OTHER; note = 2'-O-methylcytidine-3'-phosphate
  modified_base 20: mod_base = OTHER; note = 2'-O-methyladenosine-3'-phosphate
  modified_base 21: mod_base = OTHER; note = 2'-O-methyladenosine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
  misc_feature 1..5: note = RNA
  misc_feature 7..10: note = RNA
  misc_feature 12..21: note = RNA
  misc_feature 6: note = DNA
  misc_feature 11: note = DNA
ctggtatttcctagggtacaa

SEQ ID NO: 160 - DNA, 21 bp, synthetic construct
  source 1..21: mol_type = other DNA
  modified_base 1: mod_base = OTHER; note = 2'-O-methylcytidine-3'-phosphorothioate
  modified_base 2: mod_base = OTHER; note = 2'-O-methyluridine-3'-phosphorothioate
  modified_base 3: mod_base = OTHER; note = 2'-O-methylguanosine-3'-phosphate
  modified_base 4: mod_base = OTHER; note = 2'-O-methylguanosine-3'-phosphate
  modified_base 5: mod_base = OTHER; note = 2'-O-methyluridine-3'-phosphate
  modified_base 7: mod_base = OTHER; note = 2'-O-methyluridine-3'-phosphate
  modified_base 8: mod_base = OTHER; note = 2'-O-methyluridine-3'-phosphate
  modified_base 9: mod_base = OTHER; note = 2'-O-methyluridine-3'-phosphate
  modified_base 10: mod_base = OTHER; note = 2'-O-methylcytidine-3'-phosphate
  modified_base 12: mod_base = OTHER; note = 2'-O-methyluridine-3'-phosphate
  modified_base 13: mod_base = OTHER; note = 2'-O-methyladenosine-3'-phosphate
  modified_base 14: mod_base = OTHER; note = 2'-O-methylguanosine-3'-phosphate
  modified_base 15: mod_base = OTHER; note = 2'-O-methylguanosine-3'-phosphate
  modified_base 16: mod_base = OTHER; note = 2'-O-methylguanosine-3'-phosphate
  modified_base 17: mod_base = OTHER; note = Thymidine-glycol nucleic acid (GNA), S-Isomer
  modified_base 18: mod_base = OTHER; note = 2'-O-methyladenosine-3'-phosphate
  modified_base 19: mod_base = OTHER; note = 2'-O-methylcytidine-3'-phosphate
  modified_base 20: mod_base = OTHER; note = 2'-O-methyladenosine-3'-phosphate
  modified_base 21: mod_base = OTHER; note = 2'-O-methyladenosine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
  misc_feature 1..5: note = RNA
  misc_feature 7..10: note = RNA
  misc_feature 12..21: note = RNA
  misc_feature 6: note = DNA
  misc_feature 11: note = DNA
ctggtatttcctagggtacaa

SEQ ID NO: 161 - DNA, 21 bp, synthetic construct
  source 1..21: mol_type = other DNA
  modified_base 1: mod_base = OTHER; note = 2'-O-methylcytidine-3'-phosphorothioate
  modified_base 2: mod_base = OTHER; note = 2'-O-methyluridine-3'-phosphorothioate
  modified_base 3: mod_base = OTHER; note = 2'-O-methylguanosine-3'-phosphate
  modified_base 4: mod_base = OTHER; note = 2'-O-methylguanosine-3'-phosphate
  modified_base 5: mod_base = OTHER; note = 2'-O-methyluridine-3'-phosphate
  modified_base 7: mod_base = OTHER; note = 2'-O-methyluridine-3'-phosphate
  modified_base 8: mod_base = OTHER; note = 2'-O-methyluridine-3'-phosphate
  modified_base 9: mod_base = OTHER; note = 2'-O-methyluridine-3'-phosphate
  modified_base 10: mod_base = OTHER; note = 2'-O-methylcytidine-3'-phosphate
  modified_base 12: mod_base = OTHER; note = 2'-O-methyluridine-3'-phosphate
  modified_base 13: mod_base = OTHER; note = 2'-O-methyladenosine-3'-phosphate
  modified_base 14: mod_base = OTHER; note = 2'-O-methylguanosine-3'-phosphate
  modified_base 15: mod_base = OTHER; note = 2'-O-methylguanosine-3'-phosphate
  modified_base 16: mod_base = OTHER; note = 2'-O-methylguanosine-3'-phosphate
  modified_base 17: mod_base = OTHER; note = Thymidine-glycol nucleic acid (GNA), S-Isomer
  modified_base 18: mod_base = OTHER; note = 2'-O-methyladenosine-3'-phosphate
  modified_base 19: mod_base = OTHER; note = 2'-O-methylcytidine-3'-phosphate
  modified_base 20: mod_base = OTHER; note = 2'-O-methyladenosine-3'-phosphate
  modified_base 21: mod_base = OTHER; note = 2'-O-methyladenosine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
  misc_feature 1..5: note = RNA
  misc_feature 7..10: note = RNA
  misc_feature 12..21: note = RNA
  misc_feature 6: note = DNA
  misc_feature 11: note = DNA
ctggtatttcctagggtacaa

SEQ ID NO: 162 - DNA, 21 bp, synthetic construct
  source 1..21: mol_type = other DNA
  modified_base 1: mod_base = OTHER; note = 2'-O-methylcytidine-3'-phosphorothioate
  modified_base 2: mod_base = OTHER; note = 2'-O-methyluridine-3'-phosphorothioate
  modified_base 3: mod_base = OTHER; note = 2'-O-methylguanosine-3'-phosphate
  modified_base 4: mod_base = OTHER; note = 2'-O-methylguanosine-3'-phosphate
  modified_base 5: mod_base = OTHER; note = 2'-O-methyluridine-3'-phosphate
  modified_base 7: mod_base = OTHER; note = 2'-O-methyluridine-3'-phosphate
  modified_base 8: mod_base = OTHER; note = 2'-O-methyluridine-3'-phosphate
  modified_base 9: mod_base = OTHER; note = 2'-O-methyluridine-3'-phosphate
  modified_base 10: mod_base = OTHER; note = 2'-O-methylcytidine-3'-phosphate
  modified_base 12: mod_base = OTHER; note = 2'-O-methyluridine-3'-phosphate
  modified_base 13: mod_base = OTHER; note = 2'-O-methyladenosine-3'-phosphate
  modified_base 14: mod_base = OTHER; note = 2'-O-methylguanosine-3'-phosphate
  modified_base 15: mod_base = OTHER; note = 2'-O-methylguanosine-3'-phosphate
  modified_base 16: mod_base = OTHER; note = 2'-O-methylguanosine-3'-phosphate
  modified_base 18: mod_base = OTHER; note = 2'-O-methyladenosine-3'-phosphate
  modified_base 19: mod_base = OTHER; note = 2'-O-methylcytidine-3'-phosphate
  modified_base 20: mod_base = OTHER; note = 2'-O-methyladenosine-3'-phosphate
  modified_base 21: mod_base = OTHER; note = 2'-O-methyladenosine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
  misc_feature 1..5: note = RNA
  misc_feature 7..10: note = RNA
  misc_feature 12..16: note = RNA
  misc_feature 18..21: note = RNA
  misc_feature 6: note = DNA
  misc_feature 11: note = DNA
  misc_feature 17: note = DNA
ctggtatttcctagggaacaa

SEQ ID NO: 163 - DNA, 21 bp, synthetic construct
  source 1..21: mol_type = other DNA
  modified_base 1: mod_base = OTHER; note = 2'-O-methylcytidine-3'-phosphorothioate
  modified_base 2: mod_base = OTHER; note = 2'-O-methyluridine-3'-phosphorothioate
  modified_base 3: mod_base = OTHER; note = 2'-O-methylguanosine-3'-phosphate
  modified_base 4: mod_base = OTHER; note = 2'-O-methylguanosine-3'-phosphate
  modified_base 5: mod_base = OTHER; note = 2'-O-methyluridine-3'-phosphate
  modified_base 7: mod_base = OTHER; note = 2'-O-methyluridine-3'-phosphate
  modified_base 8: mod_base = OTHER; note = 2'-O-methyluridine-3'-phosphate
  modified_base 9: mod_base = OTHER; note = 2'-O-methyluridine-3'-phosphate
  modified_base 10: mod_base = OTHER; note = 2'-O-methylcytidine-3'-phosphate
  modified_base 12: mod_base = OTHER; note = 2'-O-methyluridine-3'-phosphate
  modified_base 13: mod_base = OTHER; note = 2'-O-methyladenosine-3'-phosphate
  modified_base 14: mod_base = OTHER; note = 2'-O-methylguanosine-3'-phosphate
  modified_base 15: mod_base = OTHER; note = 2'-O-methylguanosine-3'-phosphate
  modified_base 16: mod_base = OTHER; note = 2'-O-methylguanosine-3'-phosphate
  modified_base 18: mod_base = OTHER; note = 2'-O-methyladenosine-3'-phosphate
  modified_base 19: mod_base = OTHER; note = 2'-O-methylcytidine-3'-phosphate
  modified_base 20: mod_base = OTHER; note = 2'-O-methyladenosine-3'-phosphate
  modified_base 21: mod_base = OTHER; note = 2'-O-methyladenosine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
  misc_feature 1..5: note = RNA
  misc_feature 7..10: note = RNA
  misc_feature 12..16: note = RNA
  misc_feature 18..21: note = RNA
  misc_feature 6: note = DNA
  misc_feature 11: note = DNA
  misc_feature 17: note = DNA
ctggtatttcctagggaacaa

SEQ ID NO: 164 - DNA, 21 bp, synthetic construct
  source 1..21: mol_type = other DNA
  modified_base 1: mod_base = OTHER; note = 2'-O-methylcytidine-3'-phosphorothioate
  modified_base 2: mod_base = OTHER; note = 2'-O-methyluridine-3'-phosphorothioate
  modified_base 3: mod_base = OTHER; note = 2'-O-methylguanosine-3'-phosphate
  modified_base 4: mod_base = OTHER; note = 2'-O-methylguanosine-3'-phosphate
  modified_base 5: mod_base = OTHER; note = 2'-O-methyluridine-3'-phosphate
  modified_base 7: mod_base = OTHER; note = 2'-O-methyluridine-3'-phosphate
  modified_base 8: mod_base = OTHER; note = 2'-O-methyluridine-3'-phosphate
  modified_base 9: mod_base = OTHER; note = 2'-O-methyluridine-3'-phosphate
  modified_base 10: mod_base = OTHER; note = 2'-O-methylcytidine-3'-phosphate
  modified_base 12: mod_base = OTHER; note = 2'-O-methyluridine-3'-phosphate
  modified_base 13: mod_base = OTHER; note = 2'-O-methyladenosine-3'-phosphate
  modified_base 14: mod_base = OTHER; note = 2'-O-methylguanosine-3'-phosphate
  modified_base 15: mod_base = OTHER; note = 2'-O-methylguanosine-3'-phosphate
  modified_base 16: mod_base = OTHER; note = 2'-O-methylguanosine-3'-phosphate
  modified_base 18: mod_base = OTHER; note = 2'-O-methyladenosine-3'-phosphate
  modified_base 19: mod_base = OTHER; note = 2'-O-methylcytidine-3'-phosphate
  modified_base 20: mod_base = OTHER; note = 2'-O-methyladenosine-3'-phosphate
  modified_base 21: mod_base = OTHER; note = 2'-O-methyladenosine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
  misc_feature 1..5: note = RNA
  misc_feature 7..10: note = RNA
  misc_feature 12..16: note = RNA
  misc_feature 18..21: note = RNA
  misc_feature 6: note = DNA
  misc_feature 11: note = DNA
  misc_feature 17: note = DNA
ctggtatttcctagggaacaa

SEQ ID NO: 165 - DNA, 21 bp, synthetic construct
  source 1..21: mol_type = other DNA
  modified_base 1: mod_base = OTHER; note = 2'-O-methylcytidine-3'-phosphorothioate
  modified_base 2: mod_base = OTHER; note = 2'-O-methyluridine-3'-phosphorothioate
  modified_base 3: mod_base = OTHER; note = 2'-O-methylguanosine-3'-phosphate
  modified_base 4: mod_base = OTHER; note = 2'-O-methylguanosine-3'-phosphate
  modified_base 5: mod_base = OTHER; note = 2'-O-methyluridine-3'-phosphate
  modified_base 6: mod_base = OTHER; note = 2'-deoxyadenosine-3'-phosphorothioate
  modified_base 7: mod_base = OTHER; note = 2'-O-methyluridine-3'-phosphate
  modified_base 8: mod_base = OTHER; note = 2'-O-methyluridine-3'-phosphate
  modified_base 9: mod_base = OTHER; note = 2'-O-methyluridine-3'-phosphate
  modified_base 10: mod_base = OTHER; note = 2'-O-methylcytidine-3'-phosphate
  modified_base 12: mod_base = OTHER; note = 2'-O-methyluridine-3'-phosphate
  modified_base 13: mod_base = OTHER; note = 2'-O-methyladenosine-3'-phosphate
  modified_base 14: mod_base = OTHER; note = 2'-O-methylguanosine-3'-phosphate
  modified_base 15: mod_base = OTHER; note = 2'-O-methylguanosine-3'-phosphate
  modified_base 16: mod_base = OTHER; note = 2'-O-methylguanosine-3'-phosphate
  modified_base 17: mod_base = OTHER; note = Thymidine-glycol nucleic acid (GNA), S-Isomer
  modified_base 18: mod_base = OTHER; note = 2'-O-methyladenosine-3'-phosphate
  modified_base 19: mod_base = OTHER; note = 2'-O-methylcytidine-3'-phosphate
  modified_base 20: mod_base = OTHER; note = 2'-O-methyladenosine-3'-phosphate
  modified_base 21: mod_base = OTHER; note = 2'-O-methyladenosine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
  misc_feature 1..5: note = RNA
  misc_feature 7..10: note = RNA
  misc_feature 12..21: note = RNA
  misc_feature 6: note = DNA
  misc_feature 11: note = DNA
ctggtatttcctagggtacaa

SEQ ID NO: 166 - DNA, 21 bp, synthetic construct
  source 1..21: mol_type = other DNA
  modified_base 1: mod_base = OTHER; note = 2'-O-methylcytidine-3'-phosphorothioate
  modified_base 2: mod_base = OTHER; note = 2'-O-methyluridine-3'-phosphorothioate
  modified_base 3: mod_base = OTHER; note = 2'-O-methylguanosine-3'-phosphate
  modified_base 4: mod_base = OTHER; note = 2'-O-methylguanosine-3'-phosphate
  modified_base 5: mod_base = OTHER; note = 2'-O-methyluridine-3'-phosphate
  modified_base 6: mod_base = OTHER; note = 2'-deoxyadenosine-3'-phosphorothioate
  modified_base 7: mod_base = OTHER; note = 2'-O-methyluridine-3'-phosphate
  modified_base 8: mod_base = OTHER; note = 2'-O-methyluridine-3'-phosphate
  modified_base 9: mod_base = OTHER; note = 2'-O-methyluridine-3'-phosphate
  modified_base 10: mod_base = OTHER; note = 2'-O-methylcytidine-3'-phosphate
  modified_base 12: mod_base = OTHER; note = 2'-O-methyluridine-3'-phosphate
  modified_base 13: mod_base = OTHER; note = 2'-O-methyladenosine-3'-phosphate
  modified_base 14: mod_base = OTHER; note = 2'-O-methylguanosine-3'-phosphate
  modified_base 15: mod_base = OTHER; note = 2'-O-methylguanosine-3'-phosphate
  modified_base 16: mod_base = OTHER; note = 2'-O-methylguanosine-3'-phosphate
  modified_base 17: mod_base = OTHER; note = Thymidine-glycol nucleic acid (GNA), S-Isomer
  modified_base 18: mod_base = OTHER; note = 2'-O-methyladenosine-3'-phosphate
  modified_base 19: mod_base = OTHER; note = 2'-O-methylcytidine-3'-phosphate
  modified_base 20: mod_base = OTHER; note = 2'-O-methyladenosine-3'-phosphate
  modified_base 21: mod_base = OTHER; note = 2'-O-methyladenosine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
  misc_feature 1..5: note = RNA
  misc_feature 7..10: note = RNA
  misc_feature 12..21: note = RNA
  misc_feature 6: note = DNA
  misc_feature 11: note = DNA
ctggtatttcctagggtacaa

SEQ ID NO: 167 - DNA, 21 bp, synthetic construct
  source 1..21: mol_type = other DNA
  modified_base 1: mod_base = OTHER; note = 2'-O-methylcytidine-3'-phosphorothioate
  modified_base 2: mod_base = OTHER; note = 2'-O-methyluridine-3'-phosphorothioate
  modified_base 3: mod_base = OTHER; note = 2'-O-methylguanosine-3'-phosphate
  modified_base 4: mod_base = OTHER; note = 2'-O-methylguanosine-3'-phosphate
  modified_base 5: mod_base = OTHER; note = 2'-O-methyluridine-3'-phosphate
  modified_base 6: mod_base = OTHER; note = 2'-deoxyadenosine-3'-phosphorothioate
  modified_base 7: mod_base = OTHER; note = 2'-O-methyluridine-3'-phosphate
  modified_base 8: mod_base = OTHER; note = 2'-O-methyluridine-3'-phosphate
  modified_base 9: mod_base = OTHER; note = 2'-O-methyluridine-3'-phosphate
  modified_base 10: mod_base = OTHER; note = 2'-O-methylcytidine-3'-phosphate
  modified_base 12: mod_base = OTHER; note = 2'-O-methyluridine-3'-phosphate
  modified_base 13: mod_base = OTHER; note = 2'-O-methyladenosine-3'-phosphate
  modified_base 14: mod_base = OTHER; note = 2'-O-methylguanosine-3'-phosphate
  modified_base 15: mod_base = OTHER; note = 2'-O-methylguanosine-3'-phosphate
  modified_base 16: mod_base = OTHER; note = 2'-O-methylguanosine-3'-phosphate
  modified_base 17: mod_base = OTHER; note = Thymidine-glycol nucleic acid (GNA), S-Isomer
  modified_base 18: mod_base = OTHER; note = 2'-O-methyladenosine-3'-phosphate
  modified_base 19: mod_base = OTHER; note = 2'-O-methylcytidine-3'-phosphate
  modified_base 20: mod_base = OTHER; note = 2'-O-methyladenosine-3'-phosphate
  modified_base 21: mod_base = OTHER; note = 2'-O-methyladenosine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
  misc_feature 1..5: note = RNA
  misc_feature 7..10: note = RNA
  misc_feature 12..21: note = RNA
  misc_feature 6: note = DNA
  misc_feature 11: note = DNA
ctggtatttcctagggtacaa

SEQ ID NO: 168 - DNA, 21 bp, synthetic construct
  source 1..21: mol_type = other DNA
  modified_base 1: mod_base = OTHER; note = 2'-O-methyluridine-3'-phosphorothioate
  modified_base 2: mod_base = OTHER; note = 2'-O-methylguanosine-3'-phosphorothioate
  modified_base 3: mod_base = OTHER; note = 2'-O-methylguanosine-3'-phosphate
  modified_base 4: mod_base = OTHER; note = 2'-O-methyluridine-3'-phosphate
  modified_base 5: mod_base = OTHER; note = 2'-O-methyladenosine-3'-phosphate
  modified_base 7: mod_base = OTHER; note = 2'-O-methyluridine-3'-phosphate
  modified_base 8: mod_base = OTHER; note = 2'-O-methyluridine-3'-phosphate
  modified_base 9: mod_base = OTHER; note = 2'-O-methylcytidine-3'-phosphate
  modified_base 10: mod_base = OTHER; note = 2'-O-methylcytidine-3'-phosphate
  modified_base 12: mod_base = OTHER; note = 2'-O-methyladenosine-3'-phosphate
  modified_base 13: mod_base = OTHER; note = 2'-O-methylguanosine-3'-phosphate
  modified_base 14: mod_base = OTHER; note = 2'-O-methylguanosine-3'-phosphate
  modified_base 15: mod_base = OTHER; note = 2'-O-methylguanosine-3'-phosphate
  modified_base 16: mod_base = OTHER; note = 2'-O-methyluridine-3'-phosphate
  modified_base 18: mod_base = OTHER; note = 2'-O-methylcytidine-3'-phosphate
  modified_base 19: mod_base = OTHER; note = 2'-O-methyladenosine-3'-phosphate
  modified_base 20: mod_base = OTHER; note = 2'-O-methyladenosine-3'-phosphate
  modified_base 21: mod_base = OTHER; note = 2'-O-methyladenosine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
  misc_feature 1..5: note = RNA
  misc_feature 7..10: note = RNA
  misc_feature 12..16: note = RNA
  misc_feature 18..21: note = RNA
  misc_feature 6: note = DNA
  misc_feature 11: note = DNA
  misc_feature 17: note = DNA
tggtatttcctagggttcaaa

SEQ ID NO: 169 - DNA, 23 bp, synthetic construct
  source 1..23: mol_type = other DNA
  modified_base 1: mod_base = OTHER; note = 2'-O-methyluridine-3'-phosphorothioate
  modified_base 2: mod_base = OTHER; note = 2'-deoxythymidine-3'-phosphorothioate
  modified_base 3: mod_base = OTHER; note = 2'-O-methylguanosine-3'-phosphate
  modified_base 4: mod_base = OTHER; note = 2'-O-methyluridine-3'-phosphate
  modified_base 5: mod_base = OTHER; note = 2'-O-methyladenosine-3'-phosphate
  modified_base 6: mod_base = OTHER; note = 2'-O-methylcytidine-3'-phosphate
  modified_base 7: mod_base = OTHER; note = 2'-O-methylcytidine-3'-phosphate
  modified_base 8: mod_base = OTHER; note = 2'-O-methylcytidine-3'-phosphate
  modified_base 9: mod_base = OTHER; note = 2'-O-methyluridine-3'-phosphate
  modified_base 11: mod_base = OTHER; note = 2'-O-methylguanosine-3'-phosphate
  modified_base 12: mod_base = OTHER; note = 2'-O-methylguanosine-3'-phosphate
  modified_base 13: mod_base = OTHER; note = 2'-O-methyladenosine-3'-phosphate
  modified_base 15: mod_base = OTHER; note = 2'-O-methyladenosine-3'-phosphate
  modified_base 16: mod_base = OTHER; note = 2'-O-methyluridine-3'-phosphate
  modified_base 17: mod_base = OTHER; note = 2'-O-methyladenosine-3'-phosphate
  modified_base 18: mod_base = OTHER; note = 2'-O-methylcytidine-3'-phosphate
  modified_base 19: mod_base = OTHER; note = 2'-O-methylcytidine-3'-phosphate
  modified_base 20: mod_base = OTHER; note = 2'-O-methyladenosine-3'-phosphate
  modified_base 21: mod_base = OTHER; note = 2'-O-methylguanosine-3'-phosphorothioate
  modified_base 22: mod_base = OTHER; note = 2'-O-methyladenosine-3'-phosphorothioate
  modified_base 23: mod_base = OTHER; note = 2'-O-methylguanosine
  misc_feature 1: note = RNA
  misc_feature 3..9: note = RNA
  misc_feature 11..13: note = RNA
  misc_feature 15..23: note = RNA
  misc_feature 2: note = DNA
  misc_feature 10: note = DNA
  misc_feature 14: note = DNA
ttgtaccctaggaaataccagag

SEQ ID NO: 170 - DNA, 23 bp, synthetic construct
  source 1..23: mol_type = other DNA
  modified_base 1: mod_base = OTHER; note = 2'-O-methyluridine-3'-phosphorothioate
  modified_base 2: mod_base = OTHER; note = uridine-3'-phosphorothioate
  modified_base 3: mod_base = OTHER; note = 2'-O-methylguanosine-3'-phosphate
  modified_base 4: mod_base = OTHER; note = 2'-O-methyluridine-3'-phosphate
  modified_base 5: mod_base = OTHER; note = 2'-O-methyladenosine-3'-phosphate
  modified_base 6: mod_base = OTHER; note = 2'-O-methylcytidine-3'-phosphate
  modified_base 7: mod_base = OTHER; note = 2'-O-methylcytidine-3'-phosphate
  modified_base 8: mod_base = OTHER; note = 2'-O-methylcytidine-3'-phosphate
  modified_base 9: mod_base = OTHER; note = 2'-O-methyluridine-3'-phosphate
  modified_base 11: mod_base = OTHER; note = 2'-O-methylguanosine-3'-phosphate
  modified_base 12: mod_base = OTHER; note = 2'-O-methylguanosine-3'-phosphate
  modified_base 13: mod_base = OTHER; note = 2'-O-methyladenosine-3'-phosphate
  modified_base 15: mod_base = OTHER; note = 2'-O-methyladenosine-3'-phosphate
  modified_base 16: mod_base = OTHER; note = 2'-O-methyluridine-3'-phosphate
  modified_base 17: mod_base = OTHER; note = 2'-O-methyladenosine-3'-phosphate
  modified_base 18: mod_base = OTHER; note = 2'-O-methylcytidine-3'-phosphate
  modified_base 19: mod_base = OTHER; note = 2'-O-methylcytidine-3'-phosphate
  modified_base 20: mod_base = OTHER; note = 2'-O-methyladenosine-3'-phosphate
  modified_base 21: mod_base = OTHER; note = 2'-O-methylguanosine-3'-phosphorothioate
  modified_base 22: mod_base = OTHER; note = 2'-O-methyladenosine-3'-phosphorothioate
  modified_base 23: mod_base = OTHER; note = 2'-O-methylguanosine
  misc_feature 1..9: note = RNA
  misc_feature 11..13: note = RNA
  misc_feature 15..23: note = RNA
  misc_feature 10: note = DNA
  misc_feature 14: note = DNA
ttgtaccctaggaaataccagag

SEQ ID NO: 171 - DNA, 23 bp, synthetic construct
  source 1..23: mol_type = other DNA
  modified_base 1: mod_base = OTHER; note = 2'-O-methyluridine-3'-phosphorothioate
  modified_base 2: mod_base = OTHER; note = 2'-deoxythymidine-3'-phosphorothioate
  modified_base 3: mod_base = OTHER; note = 2'-O-methylguanosine-3'-phosphate
  modified_base 4: mod_base = OTHER; note = 2'-O-methyluridine-3'-phosphate
  modified_base 5: mod_base = OTHER; note = 2'-O-methyladenosine-3'-phosphate
  modified_base 6: mod_base = OTHER; note = 2'-O-methylcytidine-3'-phosphate
  modified_base 7: mod_base = OTHER; note = 2'-O-methylcytidine-3'-phosphate
  modified_base 8: mod_base = OTHER; note = 2'-O-methylcytidine-3'-phosphate
  modified_base 9: mod_base = OTHER; note = 2'-O-methyluridine-3'-phosphate
  modified_base 10: mod_base = OTHER; note = 2'-deoxyadenosine-3'-phosphorothioate
  modified_base 11: mod_base = OTHER; note = 2'-O-methylguanosine-3'-phosphate
  modified_base 12: mod_base = OTHER; note = 2'-O-methylguanosine-3'-phosphate
  modified_base 13: mod_base = OTHER; note = 2'-O-methyladenosine-3'-phosphate
  modified_base 14: mod_base = OTHER; note = 2'-deoxyadenosine-3'-phosphorothioate
  modified_base 15: mod_base = OTHER; note = 2'-O-methyladenosine-3'-phosphate
  modified_base 16: mod_base = OTHER; note = 2'-O-methyluridine-3'-phosphate
  modified_base 17: mod_base = OTHER; note = 2'-O-methyladenosine-3'-phosphate
  modified_base 18: mod_base = OTHER; note = 2'-O-methylcytidine-3'-phosphate
  modified_base 19: mod_base = OTHER; note = 2'-O-methylcytidine-3'-phosphate
  modified_base 20: mod_base = OTHER; note = 2'-O-methyladenosine-3'-phosphate
  modified_base 21: mod_base = OTHER; note = 2'-O-methylguanosine-3'-phosphorothioate
  modified_base 22: mod_base = OTHER; note = 2'-O-methyladenosine-3'-phosphorothioate
  modified_base 23: mod_base = OTHER; note = 2'-O-methylguanosine
  misc_feature 1: note = RNA
  misc_feature 3..9: note = RNA
  misc_feature 11..13: note = RNA
  misc_feature 15..23: note = RNA
  misc_feature 2: note = DNA
  misc_feature 10: note = DNA
  misc_feature 14: note = DNA
ttgtaccctaggaaataccagag

SEQ ID NO: 172 - DNA, 23 bp, synthetic construct
  source 1..23: mol_type = other DNA
  modified_base 1: mod_base = OTHER; note = 2'-O-methyluridine-3'-phosphorothioate
  modified_base 2: mod_base = OTHER; note = 2'-deoxythymidine-3'-phosphorothioate
  modified_base 3: mod_base = OTHER; note = 2'-O-methylguanosine-3'-phosphate
  modified_base 4: mod_base = OTHER; note = 2'-O-methyluridine-3'-phosphate
  modified_base 5: mod_base = OTHER; note = 2'-O-methyladenosine-3'-phosphate
  modified_base 6: mod_base = OTHER; note = 2'-O-methylcytidine-3'-phosphate
  modified_base 7: mod_base = OTHER; note = 2'-O-methylcytidine-3'-phosphate
  modified_base 8: mod_base = OTHER; note = 2'-O-methylcytidine-3'-phosphate
  modified_base 9: mod_base = OTHER; note = 2'-O-methyluridine-3'-phosphate
  modified_base 11: mod_base = OTHER; note = 2'-O-methylguanosine-3'-phosphate
  modified_base 12: mod_base = OTHER; note = 2'-O-methylguanosine-3'-phosphate
  modified_base 13: mod_base = OTHER; note = 2'-O-methyladenosine-3'-phosphate
  modified_base 15: mod_base = OTHER; note = 2'-O-methyladenosine-3'-phosphate
  modified_base 16: mod_base = OTHER; note = 2'-O-methyluridine-3'-phosphate
  modified_base 17: mod_base = OTHER; note = 2'-O-methyladenosine-3'-phosphate
  modified_base 18: mod_base = OTHER; note = 2'-O-methylcytidine-3'-phosphate
  modified_base 19: mod_base = OTHER; note = 2'-O-methylcytidine-3'-phosphate
  modified_base 20: mod_base = OTHER; note = 2'-O-methyladenosine-3'-phosphate
  modified_base 21: mod_base = OTHER; note = 2'-O-methylguanosine-3'-phosphorothioate
  modified_base 22: mod_base = OTHER; note = 2'-O-methyladenosine-3'-phosphorothioate
  modified_base 23: mod_base = OTHER; note = 2'-O-methylguanosine
  misc_feature 1: note = RNA
  misc_feature 3..9: note = RNA
  misc_feature 11..13: note = RNA
  misc_feature 15..23: note = RNA
  misc_feature 2: note = DNA
  misc_feature 10: note = DNA
  misc_feature 14: note = DNA
ttgtaccctaggaaataccagag

SEQ ID NO: 173 - DNA, 23 bp, synthetic construct
  source 1..23: mol_type = other DNA
  modified_base 1: mod_base = OTHER; note = 2'-O-methyluridine-3'-phosphorothioate
  modified_base 2: mod_base = OTHER; note = uridine-3'-phosphorothioate
  modified_base 3: mod_base = OTHER; note = 2'-O-methylguanosine-3'-phosphate
  modified_base 4: mod_base = OTHER; note = 2'-O-methyluridine-3'-phosphate
  modified_base 5: mod_base = OTHER; note = 2'-O-methyladenosine-3'-phosphate
  modified_base 6: mod_base = OTHER; note = 2'-O-methylcytidine-3'-phosphate
  modified_base 7: mod_base = OTHER; note = 2'-O-methylcytidine-3'-phosphate
  modified_base 8: mod_base = OTHER; note = 2'-O-methylcytidine-3'-phosphate
  modified_base 9: mod_base = OTHER; note = 2'-O-methyluridine-3'-phosphate
  modified_base 11: mod_base = OTHER; note = 2'-O-methylguanosine-3'-phosphate
  modified_base 12: mod_base = OTHER; note = 2'-O-methylguanosine-3'-phosphate
  modified_base 13: mod_base = OTHER; note = 2'-O-methyladenosine-3'-phosphate
  modified_base 15: mod_base = OTHER; note = 2'-O-methyladenosine-3'-phosphate
  modified_base 16: mod_base = OTHER; note = 2'-O-methyluridine-3'-phosphate
  modified_base 17: mod_base = OTHER; note = 2'-O-methyladenosine-3'-phosphate
  modified_base 18: mod_base = OTHER; note = 2'-O-methylcytidine-3'-phosphate
  modified_base 19: mod_base = OTHER; note = 2'-O-methylcytidine-3'-phosphate
  modified_base 20: mod_base = OTHER; note = 2'-O-methyladenosine-3'-phosphate
  modified_base 21: mod_base = OTHER; note = 2'-O-methylguanosine-3'-phosphorothioate
  modified_base 22: mod_base = OTHER; note = 2'-O-methyladenosine-3'-phosphorothioate
  modified_base 23: mod_base = OTHER; note = 2'-O-methylguanosine
  misc_feature 1..9: note = RNA
  misc_feature 11..13: note = RNA
  misc_feature 15..23: note = RNA
  misc_feature 10: note = DNA
  misc_feature 14: note = DNA
ttgtaccctaggaaataccagag

SEQ ID NO: 174 - DNA, 23 bp, synthetic construct
  source 1..23: mol_type = other DNA
  modified_base 1: mod_base = OTHER; note = 2'-O-methyluridine-3'-phosphorothioate
  modified_base 2: mod_base = OTHER; note = 2'-deoxythymidine-3'-phosphorothioate
  modified_base 3: mod_base = OTHER; note = 2'-O-methylguanosine-3'-phosphate
  modified_base 4: mod_base = OTHER; note = 2'-O-methyluridine-3'-phosphate
  modified_base 5: mod_base = OTHER; note = 2'-O-methyladenosine-3'-phosphate
  modified_base 6: mod_base = OTHER; note = 2'-O-methylcytidine-3'-phosphate
  modified_base 7: mod_base = OTHER; note = 2'-O-methylcytidine-3'-phosphate
  modified_base 8: mod_base = OTHER; note = 2'-O-methylcytidine-3'-phosphate
  modified_base 9: mod_base = OTHER; note = 2'-O-methyluridine-3'-phosphate
  modified_base 10: mod_base = OTHER; note = 2'-deoxyadenosine-3'-phosphorothioate
  modified_base 11: mod_base = OTHER; note = 2'-O-methylguanosine-3'-phosphate
  modified_base 12: mod_base = OTHER; note = 2'-O-methylguanosine-3'-phosphate
  modified_base 13: mod_base = OTHER; note = 2'-O-methyladenosine-3'-phosphate
  modified_base 14: mod_base = OTHER; note = 2'-deoxyadenosine-3'-phosphorothioate
  modified_base 15: mod_base = OTHER; note = 2'-O-methyladenosine-3'-phosphate
  modified_base 16: mod_base = OTHER; note = 2'-O-methyluridine-3'-phosphate
  modified_base 17: mod_base = OTHER; note = 2'-O-methyladenosine-3'-phosphate
  modified_base 18: mod_base = OTHER; note = 2'-O-methylcytidine-3'-phosphate
  modified_base 19: mod_base = OTHER; note = 2'-O-methylcytidine-3'-phosphate
  modified_base 20: mod_base = OTHER; note = 2'-O-methyladenosine-3'-phosphate
  modified_base 21: mod_base = OTHER; note = 2'-O-methylguanosine-3'-phosphorothioate
  modified_base 22: mod_base = OTHER; note = 2'-O-methyladenosine-3'-phosphorothioate
  modified_base 23: mod_base = OTHER; note = 2'-O-methylguanosine
  misc_feature 1: note = RNA
  misc_feature 3..9: note = RNA
  misc_feature 11..13: note = RNA
  misc_feature 15..23: note = RNA
  misc_feature 2: note = DNA
  misc_feature 10: note = DNA
  misc_feature 14: note = DNA
ttgtaccctaggaaataccagag

SEQ ID NO: 175 - DNA, 23 bp, synthetic construct
  source 1..23: mol_type = other DNA
  modified_base 1: mod_base = OTHER; note = 2'-O-methyluridine-3'-phosphorothioate
  modified_base 2: mod_base = OTHER; note = 2'-deoxythymidine-3'-phosphorothioate
  modified_base 3: mod_base = OTHER; note = 2'-O-methylguanosine-3'-phosphate
  modified_base 4: mod_base = OTHER; note = 2'-O-methyluridine-3'-phosphate
  modified_base 5: mod_base = OTHER; note = 2'-O-methyladenosine-3'-phosphate
  modified_base 6: mod_base = OTHER; note = 2'-O-methylcytidine-3'-phosphate
  modified_base 7: mod_base = OTHER; note = 2'-O-methylcytidine-3'-phosphate
  modified_base 8: mod_base = OTHER; note = 2'-O-methylcytidine-3'-phosphate
  modified_base 9: mod_base = OTHER; note = 2'-O-methyluridine-3'-phosphate
  modified_base 11: mod_base = OTHER; note = 2'-O-methylguanosine-3'-phosphate
  modified_base 12: mod_base = OTHER; note = 2'-O-methylguanosine-3'-phosphate
  modified_base 13: mod_base = OTHER; note = 2'-O-methyladenosine-3'-phosphate
  modified_base 15: mod_base = OTHER; note = 2'-O-methyladenosine-3'-phosphate
  modified_base 16: mod_base = OTHER; note = 2'-O-methyluridine-3'-phosphate
  modified_base 17: mod_base = OTHER; note = 2'-O-methyladenosine-3'-phosphate
  modified_base 18: mod_base = OTHER; note = 2'-O-methylcytidine-3'-phosphate
  modified_base 19: mod_base = OTHER; note = 2'-O-methylcytidine-3'-phosphate
  modified_base 20: mod_base = OTHER; note = 2'-O-methyladenosine-3'-phosphate
  modified_base 21: mod_base = OTHER; note = 2'-O-methylguanosine-3'-phosphorothioate
  modified_base 22: mod_base = OTHER; note = 2'-O-methyladenosine-3'-phosphorothioate
  modified_base 23: mod_base = OTHER; note = 2'-O-methylguanosine
  misc_feature 1: note = RNA
  misc_feature 3..9: note = RNA
  misc_feature 11..13: note = RNA
  misc_feature 15..23: note = RNA
  misc_feature 2: note = DNA
  misc_feature 10: note = DNA
  misc_feature 14: note = DNA
ttgtaccctaggaaataccagag

SEQ ID NO: 176 - DNA, 23 bp, synthetic construct
  source 1..23: mol_type = other DNA
  modified_base 1: mod_base = OTHER; note = 2'-O-methyluridine-3'-phosphorothioate
  modified_base 2: mod_base = OTHER; note = uridine-3'-phosphorothioate
  modified_base 3: mod_base = OTHER; note = 2'-O-methylguanosine-3'-phosphate
  modified_base 4: mod_base = OTHER; note = 2'-O-methyluridine-3'-phosphate
  modified_base 5: mod_base = OTHER; note = 2'-O-methyladenosine-3'-phosphate
  modified_base 6: mod_base = OTHER; note = 2'-O-methylcytidine-3'-phosphate
  modified_base 7: mod_base = OTHER; note = 2'-O-methylcytidine-3'-phosphate
  modified_base 8: mod_base = OTHER; note = 2'-O-methylcytidine-3'-phosphate
  modified_base 9: mod_base = OTHER; note = 2'-O-methyluridine-3'-phosphate
  modified_base 11: mod_base = OTHER; note = 2'-O-methylguanosine-3'-phosphate
  modified_base 12: mod_base = OTHER; note = 2'-O-methylguanosine-3'-phosphate
  modified_base 13: mod_base = OTHER; note = 2'-O-methyladenosine-3'-phosphate
  modified_base 15: mod_base = OTHER; note = 2'-O-methyladenosine-3'-phosphate
  modified_base 16: mod_base = OTHER; note = 2'-O-methyluridine-3'-phosphate
  modified_base 17: mod_base = OTHER; note = 2'-O-methyladenosine-3'-phosphate
  modified_base 18: mod_base = OTHER; note = 2'-O-methylcytidine-3'-phosphate
  modified_base 19: mod_base = OTHER; note = 2'-O-methylcytidine-3'-phosphate
  modified_base 20: mod_base = OTHER; note = 2'-O-methyladenosine-3'-phosphate
  modified_base 21: mod_base = OTHER; note = 2'-O-methylguanosine-3'-phosphorothioate
  modified_base 22: mod_base = OTHER; note = 2'-O-methyladenosine-3'-phosphorothioate
  modified_base 23: mod_base = OTHER; note = 2'-O-methylguanosine
  misc_feature 1..9: note = RNA
  misc_feature 11..13: note = RNA
  misc_feature 15..23: note = RNA
  misc_feature 10: note = DNA
  misc_feature 14: note = DNA
ttgtaccctaggaaataccagag

SEQ ID NO: 177 - DNA, 23 bp, synthetic construct
  source 1..23: mol_type = other DNA
  modified_base 1: mod_base = OTHER; note = 2'-O-methyluridine-3'-phosphorothioate
  modified_base 2: mod_base = OTHER; note = 2'-deoxythymidine-3'-phosphorothioate
  modified_base 3: mod_base = OTHER; note = 2'-O-methylguanosine-3'-phosphate
  modified_base 4: mod_base = OTHER; note = 2'-O-methyluridine-3'-phosphate
  modified_base 5: mod_base = OTHER; note = 2'-O-methyladenosine-3'-phosphate
  modified_base 6: mod_base = OTHER; note = 2'-O-methylcytidine-3'-phosphate
  modified_base 7: mod_base = OTHER; note = 2'-O-methylcytidine-3'-phosphate
  modified_base 8: mod_base = OTHER; note = 2'-O-methylcytidine-3'-phosphate
  modified_base 9: mod_base = OTHER; note = 2'-O-methyluridine-3'-phosphate
  modified_base 10: mod_base = OTHER; note = 2'-deoxyadenosine-3'-phosphorothioate
  modified_base 11: mod_base = OTHER; note = 2'-O-methylguanosine-3'-phosphate
  modified_base 12: mod_base = OTHER; note = 2'-O-methylguanosine-3'-phosphate
  modified_base 13: mod_base = OTHER; note = 2'-O-methyladenosine-3'-phosphate
  modified_base 14: mod_base = OTHER; note = 2'-deoxyadenosine-3'-phosphorothioate
  modified_base 15: mod_base = OTHER; note = 2'-O-methyladenosine-3'-phosphate
  modified_base 16: mod_base = OTHER; note = 2'-O-methyluridine-3'-phosphate
  modified_base 17: mod_base = OTHER; note = 2'-O-methyladenosine-3'-phosphate
  modified_base 18: mod_base = OTHER; note = 2'-O-methylcytidine-3'-phosphate
  modified_base 19: mod_base = OTHER; note = 2'-O-methylcytidine-3'-phosphate
  modified_base 20: mod_base = OTHER; note = 2'-O-methyladenosine-3'-phosphate
  modified_base 21: mod_base = OTHER; note = 2'-O-methylguanosine-3'-phosphorothioate
  modified_base 22: mod_base = OTHER; note = 2'-O-methyladenosine-3'-phosphorothioate
  modified_base 23: mod_base = OTHER; note = 2'-O-methylguanosine
  misc_feature 1: note = RNA
  misc_feature 3..9: note = RNA
  misc_feature 11..13: note = RNA
  misc_feature 15..23: note = RNA
  misc_feature 2: note = DNA
  misc_feature 10: note = DNA
  misc_feature 14: note = DNA
ttgtaccctaggaaataccagag

SEQ ID NO: 178 - DNA, 23 bp, synthetic construct
  source 1..23: mol_type = other DNA
  modified_base 1: mod_base = OTHER; note = 2'-O-methyluridine-3'-phosphorothioate
  modified_base 2: mod_base = OTHER; note = 2'-deoxythymidine-3'-phosphorothioate
  modified_base 3: mod_base = OTHER; note = 2'-O-methyluridine-3'-phosphate
  modified_base 4: mod_base = OTHER; note = 2'-O-methylguanosine-3'-phosphate
  modified_base 5: mod_base = OTHER; note = 2'-O-methyluridine-3'-phosphate
  modified_base 6: mod_base = OTHER; note = 2'-O-methyladenosine-3'-phosphate
  modified_base 7: mod_base = OTHER; note = 2'-O-methylcytidine-3'-phosphate
  modified_base 8: mod_base = OTHER; note = 2'-O-methylcytidine-3'-phosphate
  modified_base 9: mod_base = OTHER; note = 2'-O-methylcytidine-3'-phosphate
  modified_base 11: mod_base = OTHER; note = 2'-O-methyladenosine-3'-phosphate
  modified_base 12: mod_base = OTHER; note = 2'-O-methylguanosine-3'-phosphate
  modified_base 13: mod_base = OTHER; note = 2'-O-methylguanosine-3'-phosphate
  modified_base 15: mod_base = OTHER; note = 2'-O-methyladenosine-3'-phosphate
  modified_base 16: mod_base = OTHER; note = 2'-O-methyladenosine-3'-phosphate
  modified_base 17: mod_base = OTHER; note = 2'-O-methyluridine-3'-phosphate
  modified_base 18: mod_base = OTHER; note = 2'-O-methyladenosine-3'-phosphate
  modified_base 19: mod_base = OTHER; note = 2'-O-methylcytidine-3'-phosphate
  modified_base 20: mod_base = OTHER; note = 2'-O-methylcytidine-3'-phosphate
  modified_base 21: mod_base = OTHER; note = 2'-O-methyladenosine-3'-phosphorothioate
  modified_base 22: mod_base = OTHER; note = 2'-O-methylguanosine-3'-phosphorothioate
  modified_base 23: mod_base = OTHER; note = 2'-O-methyladenosine
  misc_feature 1: note = RNA
  misc_feature 3..9: note = RNA
  misc_feature 11..13: note = RNA
  misc_feature 15..23: note = RNA
  misc_feature 2: note = DNA
  misc_feature 10: note = DNA
  misc_feature 14: note = DNA
tttgtaccctaggaaataccaga

SEQ ID NO: 179 - RNA, 21 nt, synthetic construct
  source 1..21: mol_type = other RNA
  modified_base 1: mod_base = OTHER; note = 2'-deoxy-2'-fluoroadenosine-3'-phosphorothioate
  modified_base 2: mod_base = OTHER; note = 2'-O-methyladenosine-3'-phosphorothioate
  modified_base 3: mod_base = OTHER; note = 2'-deoxy-2'-fluorocytidine-3'-phosphate
  modified_base 4: mod_base = OTHER; note = 2'-O-methyladenosine-3'-phosphate
  modified_base 5: mod_base = OTHER; note = 2'-deoxy-2'-fluoroguanosine-3'-phosphate
  modified_base 6: mod_base = OTHER; note = 2'-O-methyluridine-3'-phosphate
  modified_base 7: mod_base = OTHER; note = 2'-deoxy-2'-fluoroguanosine-3'-phosphate
  modified_base 8: mod_base = OTHER; note = 2'-O-methyluridine-3'-phosphate
  modified_base 9: mod_base = OTHER; note = 2'-deoxy-2'-fluorouridine-3'-phosphate
  modified_base 10: mod_base = OTHER; note = 2'-deoxy-2'-fluorocytidine-3'-phosphate
  modified_base 11: mod_base = OTHER; note = 2'-deoxy-2'-fluorouridine-3'-phosphate
  modified_base 12: mod_base = OTHER; note = 2'-O-methyluridine-3'-phosphate
  modified_base 13: mod_base = OTHER; note = 2'-deoxy-2'-fluoroguanosine-3'-phosphate
  modified_base 14: mod_base = OTHER; note = 2'-O-methylcytidine-3'-phosphate
  modified_base 15: mod_base = OTHER; note = 2'-deoxy-2'-fluorouridine-3'-phosphate
  modified_base 16: mod_base = OTHER; note = 2'-O-methylcytidine-3'-phosphate
  modified_base 17: mod_base = OTHER; note = 2'-deoxy-2'-fluorouridine-3'-phosphate
  modified_base 18: mod_base = OTHER; note = 2'-O-methyladenosine-3'-phosphate
  modified_base 19: mod_base = OTHER; note = 2'-deoxy-2'-fluorouridine-3'-phosphate
  modified_base 20: mod_base = OTHER; note = 2'-O-methyladenosine-3'-phosphate
  modified_base 21: mod_base = OTHER; note = 2'-deoxy-2'-fluoroadenosine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
aacagtgttcttgctctataa

SEQ ID NO: 180 - RNA, 23 nt, synthetic construct
  source 1..23: mol_type = other RNA
  modified_base 1: mod_base = OTHER; note = 2'-O-methyluridine-3'-phosphorothioate
  modified_base 2: mod_base = OTHER; note = 2'-deoxy-2'-fluorouridine-3'-phosphorothioate
  modified_base 3: mod_base = OTHER; note = 2'-O-methyladenosine-3'-phosphate
  modified_base 4: mod_base = OTHER; note = 2'-deoxy-2'-fluorouridine-3'-phosphate
  modified_base 5: mod_base = OTHER; note = 2'-O-methyladenosine-3'-phosphate
  modified_base 6: mod_base = OTHER; note = 2'-deoxy-2'-fluoroguanosine-3'-phosphate
  modified_base 7: mod_base = OTHER; note = 2'-O-methyladenosine-3'-phosphate
  modified_base 8: mod_base = OTHER; note = 2'-deoxy-2'-fluoroguanosine-3'-phosphate
  modified_base 9: mod_base = OTHER; note = 2'-O-methylcytidine-3'-phosphate
  modified_base 10: mod_base = OTHER; note = 2'-deoxy-2'-fluoroadenosine-3'-phosphate
  modified_base 11: mod_base = OTHER; note = 2'-O-methyladenosine-3'-phosphate
  modified_base 12: mod_base = OTHER; note = 2'-O-methylguanosine-3'-phosphate
  modified_base 13: mod_base = OTHER; note = 2'-O-methyladenosine-3'-phosphate
  modified_base 14: mod_base = OTHER; note = 2'-deoxy-2'-fluoroadenosine-3'-phosphate
  modified_base 15: mod_base = OTHER; note = 2'-O-methylcytidine-3'-phosphate
  modified_base 16: mod_base = OTHER; note = 2'-deoxy-2'-fluoroadenosine-3'-phosphate
  modified_base 17: mod_base = OTHER; note = 2'-O-methylcytidine-3'-phosphate
  modified_base 18: mod_base = OTHER; note = 2'-deoxy-2'-fluorouridine-3'-phosphate
  modified_base 19: mod_base = OTHER; note = 2'-O-methylguanosine-3'-phosphate
  modified_base 20: mod_base = OTHER; note = 2'-deoxy-2'-fluorouridine-3'-phosphate
  modified_base 21: mod_base = OTHER; note = 2'-O-methyluridine-3'-phosphorothioate
  modified_base 22: mod_base = OTHER; note = 2'-O-methyluridine-3'-phosphorothioate
  modified_base 23: mod_base = OTHER; note = 2'-O-methyluridine
ttatagagcaagaacactgtttt

SEQ ID NO: 181 - RNA, 21 nt, synthetic construct
  source 1..21: mol_type = other RNA
  modified_base 1: mod_base = OTHER; note = 2'-deoxy-2'-fluoroguanosine-3'-phosphorothioate
  modified_base 2: mod_base = OTHER; note = 2'-O-methylcytidine-3'-phosphorothioate
  modified_base 3: mod_base = OTHER; note = 2'-deoxy-2'-fluorouridine-3'-phosphate
  modified_base 4: mod_base = OTHER; note = 2'-O-methyluridine-3'-phosphate
  modified_base 5: mod_base = OTHER; note = 2'-deoxy-2'-fluoroadenosine-3'-phosphate
  modified_base 6: mod_base = OTHER; note = 2'-O-methyladenosine-3'-phosphate
  modified_base 7: mod_base = OTHER; note = 2'-deoxy-2'-fluoroadenosine-3'-phosphate
  modified_base 8: mod_base = OTHER; note = 2'-O-methyladenosine-3'-phosphate
  modified_base 9: mod_base = OTHER; note = 2'-deoxy-2'-fluoroguanosine-3'-phosphate
  modified_base 10: mod_base = OTHER; note = 2'-deoxy-2'-fluoroguanosine-3'-phosphate
  modified_base 11: mod_base = OTHER; note = 2'-deoxy-2'-fluoroguanosine-3'-phosphate
  modified_base 12: mod_base = OTHER; note = 2'-O-methyladenosine-3'-phosphate
  modified_base 13: mod_base = OTHER; note = 2'-deoxy-2'-fluorocytidine-3'-phosphate
  modified_base 14: mod_base = OTHER; note = 2'-O-methyladenosine-3'-phosphate
  modified_base 15: mod_base = OTHER; note = 2'-deoxy-2'-fluoroguanosine-3'-phosphate
  modified_base 16: mod_base = OTHER; note = 2'-O-methyluridine-3'-phosphate
  modified_base 17: mod_base = OTHER; note = 2'-deoxy-2'-fluoroadenosine-3'-phosphate
  modified_base 18: mod_base = OTHER; note = 2'-O-methyluridine-3'-phosphate
  modified_base 19: mod_base = OTHER; note = 2'-deoxy-2'-fluorouridine-3'-phosphate
  modified_base 20: mod_base = OTHER; note = 2'-O-methylcytidine-3'-phosphate
  modified_base 21: mod_base = OTHER; note = 2'-deoxy-2'-fluorouridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
gcttaaaagggacagtattct

SEQ ID NO: 182 - RNA, 23 nt, synthetic construct
  source 1..23: mol_type = other RNA
  modified_base 1: mod_base = OTHER; note = 2'-O-methyladenosine-3'-phosphorothioate
  modified_base 2: mod_base = OTHER; note = 2'-deoxy-2'-fluoroguanosine-3'-phosphorothioate
  modified_base 3: mod_base = OTHER; note = 2'-O-methyladenosine-3'-phosphate
  modified_base 4: mod_base = OTHER; note = 2'-deoxy-2'-fluoroadenosine-3'-phosphate
  modified_base 5: mod_base = OTHER; note = 2'-O-methyluridine-3'-phosphate
  modified_base 6: mod_base = OTHER; note = 2'-deoxy-2'-fluoroadenosine-3'-phosphate
  modified_base 7: mod_base = OTHER; note = 2'-O-methylcytidine-3'-phosphate
  modified_base 8: mod_base = OTHER; note = 2'-deoxy-2'-fluorouridine-3'-phosphate
  modified_base 9: mod_base = OTHER; note = 2'-O-methylguanosine-3'-phosphate
  modified_base 10: mod_base = OTHER; note = 2'-deoxy-2'-fluorouridine-3'-phosphate
  modified_base 11: mod_base = OTHER; note = 2'-O-methylcytidine-3'-phosphate
  modified_base 12: mod_base = OTHER; note = 2'-O-methylcytidine-3'-phosphate
  modified_base 13: mod_base = OTHER; note = 2'-O-methylcytidine-3'-phosphate
  modified_base 14: mod_base = OTHER; note = 2'-deoxy-2'-fluorouridine-3'-phosphate
  modified_base 15: mod_base = OTHER; note = 2'-O-methyluridine-3'-phosphate
  modified_base 16: mod_base = OTHER; note = 2'-deoxy-2'-fluorouridine-3'-phosphate
  modified_base 17: mod_base = OTHER; note = 2'-O-methyluridine-3'-phosphate
  modified_base 18: mod_base = OTHER; note = 2'-deoxy-2'-fluoroadenosine-3'-phosphate
  modified_base 19: mod_base = OTHER; note = 2'-O-methyladenosine-3'-phosphate
  modified_base 20: mod_base = OTHER; note = 2'-deoxy-2'-fluoroguanosine-3'-phosphate
  modified_base 21: mod_base = OTHER; note = 2'-O-methylcytidine-3'-phosphorothioate
  modified_base 22: mod_base = OTHER; note = 2'-deoxy-2'-fluoroadenosine-3'-phosphorothioate
  modified_base 23: mod_base = OTHER; note = 2'-O-methyladenosine
agaatactgtcccttttaagcaa

SEQ ID NO: 183 - RNA, 21 nt, synthetic construct
  source 1..21: mol_type = other RNA
  modified_base 1: mod_base = OTHER; note = 2'-deoxy-2'-fluorocytidine-3'-phosphorothioate
  modified_base 2: mod_base = OTHER; note = 2'-O-methyluridine-3'-phosphorothioate
  modified_base 3: mod_base = OTHER; note = 2'-deoxy-2'-fluorouridine-3'-phosphate
  modified_base 4: mod_base = OTHER; note = 2'-O-methylguanosine-3'-phosphate
  modified_base 5: mod_base = OTHER; note = 2'-deoxy-2'-fluorocytidine-3'-phosphate
  modified_base 6: mod_base = OTHER; note = 2'-O-methyluridine-3'-phosphate
  modified_base 7: mod_base = OTHER; note = 2'-deoxy-2'-fluorocytidine-3'-phosphate
  modified_base 8: mod_base = OTHER; note = 2'-O-methyluridine-3'-phosphate
  modified_base 9: mod_base = OTHER; note = 2'-deoxy-2'-fluoroadenosine-3'-phosphate
  modified_base 10: mod_base = OTHER; note = 2'-deoxy-2'-fluorouridine-3'-phosphate
  modified_base 11: mod_base = OTHER; note = 2'-deoxy-2'-fluoroadenosine-3'-phosphate
  modified_base 12: mod_base = OTHER; note = 2'-O-methyladenosine-3'-phosphate
  modified_base 13: mod_base = OTHER; note = 2'-deoxy-2'-fluoroadenosine-3'-phosphate
  modified_base 14: mod_base = OTHER; note = 2'-O-methylcytidine-3'-phosphate
  modified_base 15: mod_base = OTHER; note = 2'-deoxy-2'-fluorocytidine-3'-phosphate
  modified_base 16: mod_base = OTHER; note = 2'-O-methylguanosine-3'-phosphate
  modified_base 17: mod_base = OTHER; note = 2'-deoxy-2'-fluorouridine-3'-phosphate
  modified_base 18: mod_base = OTHER; note = 2'-O-methylguanosine-3'-phosphate
  modified_base 19: mod_base = OTHER; note = 2'-deoxy-2'-fluorouridine-3'-phosphate
  modified_base 20: mod_base = OTHER; note = 2'-O-methyluridine-3'-phosphate
  modified_base 21: mod_base = OTHER; note = 2'-deoxy-2'-fluoroadenosine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
cttgctctataaaccgtgtta

SEQ ID NO: 184 - RNA, 23 nt, synthetic construct
  source 1..23: mol_type = other RNA
  modified_base 1: mod_base = OTHER; note = 2'-O-methyluridine-3'-phosphorothioate
  modified_base 2: mod_base = OTHER; note = 2'-deoxy-2'-fluoroadenosine-3'-phosphorothioate
  modified_base 3: mod_base = OTHER; note = 2'-O-methyladenosine-3'-phosphate
  modified_base 4: mod_base = OTHER; note = 2'-deoxy-2'-fluorocytidine-3'-phosphate
  modified_base 5: mod_base = OTHER; note = 2'-O-methyladenosine-3'-phosphate
  modified_base 6: mod_base = OTHER; note = 2'-deoxy-2'-fluorocytidine-3'-phosphate
  modified_base 7: mod_base = OTHER; note = 2'-O-methylguanosine-3'-phosphate
  modified_base 8: mod_base = OTHER; note = 2'-deoxy-2'-fluoroguanosine-3'-phosphate
  modified_base 9: mod_base = OTHER; note = 2'-O-methyluridine-3'-phosphate
  modified_base 10: mod_base = OTHER; note = 2'-deoxy-2'-fluorouridine-3'-phosphate
  modified_base 11: mod_base = OTHER; note = 2'-O-methyluridine-3'-phosphate
  modified_base 12: mod_base = OTHER; note = 2'-O-methyladenosine-3'-phosphate
  modified_base 13: mod_base = OTHER; note = 2'-O-methyluridine-3'-phosphate
  modified_base 14: mod_base = OTHER; note = 2'-deoxy-2'-fluoroadenosine-3'-phosphate
  modified_base 15: mod_base = OTHER; note = 2'-O-methylguanosine-3'-phosphate
  modified_base 16: mod_base = OTHER; note = 2'-deoxy-2'-fluoroadenosine-3'-phosphate
  modified_base 17: mod_base = OTHER; note = 2'-O-methylguanosine-3'-phosphate
  modified_base 18: mod_base = OTHER; note = 2'-deoxy-2'-fluorocytidine-3'-phosphate
  modified_base 19: mod_base = OTHER; note = 2'-O-methyladenosine-3'-phosphate
  modified_base 20: mod_base = OTHER; note = 2'-deoxy-2'-fluoroadenosine-3'-phosphate
  modified_base 21: mod_base = OTHER; note = 2'-O-methylguanosine-3'-phosphorothioate
  modified_base 22: mod_base = OTHER; note = 2'-O-methyladenosine-3'-phosphorothioate
  modified_base 23: mod_base = OTHER; note = 2'-O-methyladenosine
taacacggtttatagagcaagaa

SEQ ID NO: 185 - RNA, 21 nt, synthetic construct
  source 1..21: mol_type = other RNA
  modified_base 1: mod_base = OTHER; note = 2'-deoxy-2'-fluorouridine-3'-phosphorothioate
  modified_base 2: mod_base = OTHER; note = 2'-O-methylcytidine-3'-phosphorothioate
  modified_base 3: mod_base = OTHER; note = 2'-deoxy-2'-fluorocytidine-3'-phosphate
  modified_base 4: mod_base = OTHER; note = 2'-O-methyluridine-3'-phosphate
  modified_base 5: mod_base = OTHER; note = 2'-deoxy-2'-fluorocytidine-3'-phosphate
  modified_base 6: mod_base = OTHER; note = 2'-O-methyluridine-3'-phosphate
  modified_base 7: mod_base = OTHER; note = 2'-deoxy-2'-fluoroguanosine-3'-phosphate
  modified_base 8: mod_base = OTHER; note = 2'-O-methyladenosine-3'-phosphate
  modified_base 9: mod_base = OTHER; note = 2'-deoxy-2'-fluorouridine-3'-phosphate
  modified_base 10: mod_base = OTHER; note = 2'-deoxy-2'-fluoroguanosine-3'-phosphate
  modified_base 11: mod_base = OTHER; note = 2'-deoxy-2'-fluoroguanosine-3'-phosphate
  modified_base 12: mod_base = OTHER; note = 2'-O-methyluridine-3'-phosphate
  modified_base 13: mod_base = OTHER; note = 2'-deoxy-2'-fluorocytidine-3'-phosphate
  modified_base 14: mod_base = OTHER; note = 2'-O-methyladenosine-3'-phosphate
  modified_base 15: mod_base = OTHER; note = 2'-deoxy-2'-fluoroadenosine-3'-phosphate
  modified_base 16: mod_base = OTHER; note = 2'-O-methyladenosine-3'-phosphate
  modified_base 17: mod_base = OTHER; note = 2'-deoxy-2'-fluoroguanosine-3'-phosphate
  modified_base 18: mod_base = OTHER; note = 2'-O-methyluridine-3'-phosphate
  modified_base 19: mod_base = OTHER; note = 2'-deoxy-2'-fluorocytidine-3'-phosphate
  modified_base 20: mod_base = OTHER; note = 2'-O-methylcytidine-3'-phosphate
  modified_base 21: mod_base = OTHER; note = 2'-deoxy-2'-fluorouridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
tcctctgatggtcaaagtcct

SEQ ID NO: 186 - RNA, 23 nt, synthetic construct
  source 1..23: mol_type = other RNA
  modified_base 1: mod_base = OTHER; note = 2'-O-methyladenosine-3'-phosphorothioate
  modified_base 2: mod_base = OTHER; note = 2'-deoxy-2'-fluoroguanosine-3'-phosphorothioate
  modified_base 3: mod_base = OTHER; note = 2'-O-methylguanosine-3'-phosphate
  modified_base 4: mod_base = OTHER; note = 2'-deoxy-2'-fluoroadenosine-3'-phosphate
  modified_base 5: mod_base = OTHER; note = 2'-O-methylcytidine-3'-phosphate
  modified_base 6: mod_base = OTHER; note = 2'-deoxy-2'-fluorouridine-3'-phosphate
  modified_base 7: mod_base = OTHER; note = 2'-O-methyluridine-3'-phosphate
  modified_base 8: mod_base = OTHER; note = 2'-deoxy-2'-fluorouridine-3'-phosphate
  modified_base 9: mod_base = OTHER; note = 2'-O-methylguanosine-3'-phosphate
  modified_base 10: mod_base = OTHER; note = 2'-deoxy-2'-fluoroadenosine-3'-phosphate
  modified_base 11: mod_base = OTHER; note = 2'-O-methylcytidine-3'-phosphate
  modified_base 12: mod_base = OTHER; note = 2'-O-methylcytidine-3'-phosphate
  modified_base 13: mod_base = OTHER; note = 2'-O-methyladenosine-3'-phosphate
  modified_base 14: mod_base = OTHER; note = 2'-deoxy-2'-fluorouridine-3'-phosphate
  modified_base 15: mod_base = OTHER; note = 2'-O-methylcytidine-3'-phosphate
  modified_base 16: mod_base = OTHER; note = 2'-deoxy-2'-fluoroadenosine-3'-phosphate
  modified_base 17: mod_base = OTHER; note = 2'-O-methylguanosine-3'-phosphate
  modified_base 18: mod_base = OTHER; note = 2'-deoxy-2'-fluoroadenosine-3'-phosphate
  modified_base 19: mod_base = OTHER; note = 2'-O-methylguanosine-3'-phosphate
  modified_base 20: mod_base = OTHER; note = 2'-deoxy-2'-fluoroguanosine-3'-phosphate
  modified_base 21: mod_base = OTHER; note = 2'-O-methyladenosine-3'-phosphorothioate
  modified_base 22: mod_base = OTHER; note = 2'-O-methylcytidine-3'-phosphorothioate
  modified_base 23: mod_base = OTHER; note = 2'-O-methyladenosine
aggactttgaccatcagaggaca

SEQ ID NO: 187 - RNA, 21 nt, synthetic construct
  source 1..21: mol_type = other RNA
  modified_base 1: mod_base = OTHER; note = 2'-O-methylguanosine-3'-phosphorothioate
  modified_base 2: mod_base = OTHER; note = 2'-O-methylcytidine-3'-phosphorothioate
  modified_base 3: mod_base = OTHER; note = 2'-O-methyluridine-3'-phosphate
  modified_base 4: mod_base = OTHER; note = 2'-O-methyluridine-3'-phosphate
  modified_base 5: mod_base = OTHER; note = 2'-O-methyladenosine-3'-phosphate
  modified_base 6: mod_base = OTHER; note = 2'-O-methyladenosine-3'-phosphate
  modified_base 7: mod_base = OTHER; note = 2'-deoxy-2'-fluoroadenosine-3'-phosphate
  modified_base 8: mod_base = OTHER; note = 2'-O-methyladenosine-3'-phosphate
  modified_base 9: mod_base = OTHER; note = 2'-deoxy-2'-fluoroguanosine-3'-phosphate
  modified_base 10: mod_base = OTHER; note = 2'-deoxy-2'-fluoroguanosine-3'-phosphate
  modified_base 11: mod_base = OTHER; note = 2'-deoxy-2'-fluoroguanosine-3'-phosphate
  modified_base 12: mod_base = OTHER; note = 2'-O-methyladenosine-3'-phosphate
  modified_base 13: mod_base = OTHER; note = 2'-O-methylcytidine-3'-phosphate
  modified_base 14: mod_base = OTHER; note = 2'-O-methyladenosine-3'-phosphate
  modified_base 15: mod_base = OTHER; note = 2'-O-methylguanosine-3'-phosphate
  modified_base 16: mod_base = OTHER; note = 2'-O-methyluridine-3'-phosphate
  modified_base 17: mod_base = OTHER; note = 2'-O-methyladenosine-3'-phosphate
  modified_base 18: mod_base = OTHER; note = 2'-O-methyluridine-3'-phosphate
  modified_base 19: mod_base = OTHER; note = 2'-O-methyluridine-3'-phosphate
  modified_base 20: mod_base = OTHER; note = 2'-O-methylcytidine-3'-phosphate
  modified_base 21: mod_base = OTHER; note = 2'-O-methyladenosine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
gcttaaaagggacagtattca

SEQ ID NO: 188 - RNA, 23 nt, synthetic construct
  source 1..23: mol_type = other RNA
  modified_base 1: mod_base = OTHER; note = 2'-O-methyluridine-3'-phosphorothioate
  modified_base 2: mod_base = OTHER; note = 2'-deoxy-2'-fluoroguanosine-3'-phosphorothioate
  modified_base 3: mod_base = OTHER; note = 2'-O-methyladenosine-3'-phosphate
  modified_base 4: mod_base = OTHER; note = 2'-O-methyladenosine-3'-phosphate
  modified_base 5: mod_base = OTHER; note = 2'-O-methyluridine-3'-phosphate
  modified_base 6: mod_base = OTHER; note = 2'-deoxy-2'-fluoroadenosine-3'-phosphate
  modified_base 7: mod_base = OTHER; note = 2'-O-methylcytidine-3'-phosphate
  modified_base 8: mod_base = OTHER; note = 2'-deoxy-2'-fluorouridine-3'-phosphate
  modified_base 9: mod_base = OTHER; note = 2'-deoxy-2'-fluoroguanosine-3'-phosphate
  modified_base 10: mod_base = OTHER; note = 2'-O-methyluridine-3'-phosphate
  modified_base 11: mod_base = OTHER; note = 2'-O-methylcytidine-3'-phosphate
  modified_base 12: mod_base = OTHER; note = 2'-O-methylcytidine-3'-phosphate
  modified_base 13: mod_base = OTHER; note = 2'-O-methylcytidine-3'-phosphate
  modified_base 14: mod_base = OTHER; note = 2'-deoxy-2'-fluorouridine-3'-phosphate
  modified_base 15: mod_base = OTHER; note = 2'-O-methyluridine-3'-phosphate
  modified_base 16: mod_base = OTHER; note = 2'-deoxy-2'-fluorouridine-3'-phosphate
  modified_base 17: mod_base = OTHER; note = 2'-O-methyluridine-3'-phosphate
  modified_base 18: mod_base = OTHER; note = 2'-O-methyladenosine-3'-phosphate
  modified_base 19: mod_base = OTHER; note = 2'-O-methyladenosine-3'-phosphate
  modified_base 20: mod_base = OTHER; note = 2'-O-methylguanosine-3'-phosphate
  modified_base 21: mod_base = OTHER; note = 2'-O-methylcytidine-3'-phosphorothioate
  modified_base 22: mod_base = OTHER; note = 2'-O-methyladenosine-3'-phosphorothioate
  modified_base 23: mod_base = OTHER; note = 2'-O-methyladenosine
tgaatactgtcccttttaagcaa

SEQ ID NO: 189 - RNA, 21 nt, synthetic construct
  source 1..21: mol_type = other RNA
  modified_base 1: mod_base = OTHER; note = 2'-O-methylguanosine-3'-phosphorothioate
  modified_base 2: mod_base = OTHER; note = 2'-O-methylcytidine-3'-phosphorothioate
  modified_base 3: mod_base = OTHER; note = 2'-O-methyluridine-3'-phosphate
  modified_base 4: mod_base = OTHER; note = 2'-O-methyluridine-3'-phosphate
  modified_base 5: mod_base = OTHER; note = 2'-O-methyladenosine-3'-phosphate
  modified_base 6: mod_base = OTHER; note = 2'-O-methyladenosine-3'-phosphate
  modified_base 7: mod_base = OTHER; note = 2'-deoxy-2'-fluoroadenosine-3'-phosphate
  modified_base 8: mod_base = OTHER; note = 2'-O-methyladenosine-3'-phosphate
  modified_base 9: mod_base = OTHER; note = 2'-deoxy-2'-fluoroguanosine-3'-phosphate
  modified_base 10: mod_base = OTHER; note = 2'-deoxy-2'-fluoroguanosine-3'-phosphate
  modified_base 11: mod_base = OTHER; note = 2'-deoxy-2'-fluoroguanosine-3'-phosphate
  modified_base 12: mod_base = OTHER; note = 2'-O-methyladenosine-3'-phosphate
  modified_base 13: mod_base = OTHER; note = 2'-O-methylcytidine-3'-phosphate
  modified_base 14: mod_base = OTHER; note = 2'-O-methyladenosine-3'-phosphate
  modified_base 15: mod_base = OTHER; note = 2'-O-methylguanosine-3'-phosphate
  modified_base 16: mod_base = OTHER; note = 2'-O-methyluridine-3'-phosphate
  modified_base 17: mod_base = OTHER; note = 2'-O-methyladenosine-3'-phosphate
  modified_base 18: mod_base = OTHER; note = 2'-O-methyluridine-3'-phosphate
  modified_base 19: mod_base = OTHER; note = 2'-O-methyluridine-3'-phosphate
  modified_base 20: mod_base = OTHER; note = 2'-O-methylcytidine-3'-phosphate
  modified_base 21: mod_base = OTHER; note = 2'-O-methyladenosine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
gcttaaaagggacagtattca

SEQ ID NO: 190 - RNA, 23 nt, synthetic construct
  source 1..23: mol_type = other RNA
  modified_base 1: mod_base = OTHER; note = 2'-O-methyluridine-3'-phosphorothioate
  modified_base 2: mod_base = OTHER; note = 2'-deoxy-2'-fluoroguanosine-3'-phosphorothioate
  modified_base 3: mod_base = OTHER; note = 2'-O-methyladenosine-3'-phosphate
  modified_base 4: mod_base = OTHER; note = 2'-O-methyladenosine-3'-phosphate
  modified_base 5: mod_base = OTHER; note = 2'-O-methyluridine-3'-phosphate
  modified_base 6: mod_base = OTHER; note = 2'-O-methyladenosine-3'-phosphate
  modified_base 7: mod_base = OTHER; note = 2'-O-methylcytidine-3'-phosphate
  modified_base 8: mod_base = OTHER; note = 2'-O-methyluridine-3'-phosphate
  modified_base 9: mod_base = OTHER; note = 2'-O-methylguanosine-3'-phosphate
  modified_base 10: mod_base = OTHER; note = 2'-O-methyluridine-3'-phosphate
  modified_base 11: mod_base = OTHER; note = 2'-O-methylcytidine-3'-phosphate
  modified_base 12: mod_base = OTHER; note = 2'-O-methylcytidine-3'-phosphate
  modified_base 13: mod_base = OTHER; note = 2'-O-methylcytidine-3'-phosphate
  modified_base 14: mod_base = OTHER; note = 2'-deoxy-2'-fluorouridine-3'-phosphate
  modified_base 15: mod_base = OTHER; note = 2'-O-methyluridine-3'-phosphate
  modified_base 16: mod_base = OTHER; note = 2'-O-methyluridine-3'-phosphate
  modified_base 17: mod_base = OTHER; note = 2'-O-methyluridine-3'-phosphate
  modified_base 18: mod_base = OTHER; note = 2'-O-methyladenosine-3'-phosphate
  modified_base 19: mod_base = OTHER; note = 2'-O-methyladenosine-3'-phosphate
  modified_base 20: mod_base = OTHER; note = 2'-O-methylguanosine-3'-phosphate
  modified_base 21: mod_base = OTHER; note = 2'-O-methylcytidine-3'-phosphorothioate
  modified_base 22: mod_base = OTHER; note = 2'-O-methyladenosine-3'-phosphorothioate
  modified_base 23: mod_base = OTHER; note = 2'-O-methyladenosine
tgaatactgtcccttttaagcaa

SEQ ID NO: 191 - RNA, 21 nt, synthetic construct
  source 1..21: mol_type = other RNA
  modified_base 1: mod_base = OTHER; note = 2'-deoxy-2'-fluoroadenosine-3'-phosphorothioate
  modified_base 2: mod_base = OTHER; note = 2'-O-methyladenosine-3'-phosphorothioate
  modified_base 3: mod_base = OTHER; note = 2'-deoxy-2'-fluoroadenosine-3'-phosphate
  modified_base 4: mod_base = OTHER; note = 2'-O-methylguanosine-3'-phosphate
  modified_base 5: mod_base = OTHER; note = 2'-deoxy-2'-fluoroadenosine-3'-phosphate
  modified_base 6: mod_base = OTHER; note = 2'-O-methylguanosine-3'-phosphate
  modified_base 7: mod_base = OTHER; note = 2'-deoxy-2'-fluoroguanosine-3'-phosphate
  modified_base 8: mod_base = OTHER; note = 2'-O-methyluridine-3'-phosphate
  modified_base 9: mod_base = OTHER; note = 2'-deoxy-2'-fluoroguanosine-3'-phosphate
  modified_base 10: mod_base = OTHER; note = 2'-deoxy-2'-fluorouridine-3'-phosphate
  modified_base 11: mod_base = OTHER; note = 2'-deoxy-2'-fluoroadenosine-3'-phosphate
  modified_base 12: mod_base = OTHER; note = 2'-O-methyluridine-3'-phosphate
  modified_base 13: mod_base = OTHER; note = 2'-deoxy-2'-fluoroguanosine-3'-phosphate
  modified_base 14: mod_base = OTHER; note = 2'-O-methylguanosine-3'-phosphate
  modified_base 15: mod_base = OTHER; note = 2'-deoxy-2'-fluorocytidine-3'-phosphate
  modified_base 16: mod_base = OTHER; note = 2'-O-methyluridine-3'-phosphate
  modified_base 17: mod_base = OTHER; note = 2'-deoxy-2'-fluorouridine-3'-phosphate
  modified_base 18: mod_base = OTHER; note = 2'-O-methylcytidine-3'-phosphate
  modified_base 19: mod_base = OTHER; note = 2'-deoxy-2'-fluoroadenosine-3'-phosphate
  modified_base 20: mod_base = OTHER; note = 2'-O-methyladenosine-3'-phosphate
  modified_base 21: mod_base = OTHER; note = 2'-deoxy-2'-fluoroadenosine-3'-phosphate 0
aaagaggtgtatggcttcaaa

SEQ ID NO: 192 - RNA, 21 nt, synthetic construct
  source 1..21: mol_type = other RNA
  modified_base 1: mod_base = OTHER; note = 2'-deoxy-2'-fluoroadenosine-3'-phosphorothioate
  modified_base 2: mod_base = OTHER; note = 2'-O-methyladenosine-3'-phosphorothioate
  modified_base 3: mod_base = OTHER; note = 2'-deoxy-2'-fluoroadenosine-3'-phosphate
  modified_base 4: mod_base = OTHER; note = 2'-O-methylguanosine-3'-phosphate
  modified_base 5: mod_base = OTHER; note = 2'-deoxy-2'-fluoroadenosine-3'-phosphate
  modified_base 6: mod_base = OTHER; note = 2'-O-methylguanosine-3'-phosphate
  modified_base 7: mod_base = OTHER; note = 2'-deoxy-2'-fluoroguanosine-3'-phosphate
  modified_base 8: mod_base = OTHER; note = 2'-O-methyluridine-3'-phosphate
  modified_base 9: mod_base = OTHER; note = 2'-deoxy-2'-fluoroguanosine-3'-phosphate
  modified_base 10: mod_base = OTHER; note = 2'-deoxy-2'-fluorouridine-3'-phosphate
  modified_base 11: mod_base = OTHER; note = 2'-deoxy-2'-fluoroadenosine-3'-phosphate
  modified_base 12: mod_base = OTHER; note = 2'-O-methyluridine-3'-phosphate
  modified_base 13: mod_base = OTHER; note = 2'-deoxy-2'-fluoroguanosine-3'-phosphate
  modified_base 14: mod_base = OTHER; note = 2'-O-methylguanosine-3'-phosphate
  modified_base 15: mod_base = OTHER; note = 2'-deoxy-2'-fluorocytidine-3'-phosphate
  modified_base 16: mod_base = OTHER; note = 2'-O-methyluridine-3'-phosphate
  modified_base 17: mod_base = OTHER; note = 2'-deoxy-2'-fluorouridine-3'-phosphate
  modified_base 18: mod_base = OTHER; note = 2'-O-methylcytidine-3'-phosphate
  modified_base 19: mod_base = OTHER; note = 2'-deoxy-2'-fluoroadenosine-3'-phosphate
  modified_base 20: mod_base = OTHER; note = 2'-O-methyladenosine-3'-phosphate
  modified_base 21: mod_base = OTHER; note = 2'-deoxy-2'-fluoroadenosine-3'-phosphate 0
aaagaggtgtatggcttcaaa

SEQ ID NO: 193 - RNA, 21 nt, synthetic construct
  source 1..21: mol_type = other RNA
  modified_base 1: mod_base = OTHER; note = 2'-deoxy-2'-fluorocytidine-3'-phosphorothioate
  modified_base 2: mod_base = OTHER; note = 2'-O-methyluridine-3'-phosphorothioate
  modified_base 3: mod_base = OTHER; note = 2'-deoxy-2'-fluoroguanosine-3'-phosphate
  modified_base 4: mod_base = OTHER; note = 2'-O-methylguanosine-3'-phosphate
  modified_base 5: mod_base = OTHER; note = 2'-deoxy-2'-fluoroadenosine-3'-phosphate
  modified_base 6: mod_base = OTHER; note = 2'-O-methylcytidine-3'-phosphate
  modified_base 7: mod_base = OTHER; note = 2'-deoxy-2'-fluoroadenosine-3'-phosphate
  modified_base 8: mod_base = OTHER; note = 2'-O-methyluridine-3'-phosphate
  modified_base 9: mod_base = OTHER; note = 2'-deoxy-2'-fluorouridine-3'-phosphate
  modified_base 10: mod_base = OTHER; note = 2'-deoxy-2'-fluorocytidine-3'-phosphate
  modified_base 11: mod_base = OTHER; note = 2'-deoxy-2'-fluoroadenosine-3'-phosphate
  modified_base 12: mod_base = OTHER; note = 2'-O-methylguanosine-3'-phosphate
  modified_base 13: mod_base = OTHER; note = 2'-deoxy-2'-fluoroadenosine-3'-phosphate
  modified_base 14: mod_base = OTHER; note = 2'-O-methyladenosine-3'-phosphate
  modified_base 15: mod_base = OTHER; note = 2'-deoxy-2'-fluorocytidine-3'-phosphate
  modified_base 16: mod_base = OTHER; note = 2'-O-methyladenosine-3'-phosphate
  modified_base 17: mod_base = OTHER; note = 2'-deoxy-2'-fluoroadenosine-3'-phosphate
  modified_base 18: mod_base = OTHER; note = 2'-O-methylguanosine-3'-phosphate
  modified_base 19: mod_base = OTHER; note = 2'-deoxy-2'-fluoroadenosine-3'-phosphate
  modified_base 20: mod_base = OTHER; note = 2'-O-methyladenosine-3'-phosphate
  modified_base 21: mod_base = OTHER; note = 2'-deoxy-2'-fluoroadenosine-3'-phosphate 0
ctggacattcagaacaagaaa

SEQ ID NO: 194 - RNA, 21 nt, synthetic construct
  source 1..21: mol_type = other RNA
  modified_base 1: mod_base = OTHER; note = 2'-deoxy-2'-fluorocytidine-3'-phosphorothioate
  modified_base 2: mod_base = OTHER; note = 2'-O-methyluridine-3'-phosphorothioate
  modified_base 3: mod_base = OTHER; note = 2'-deoxy-2'-fluoroguanosine-3'-phosphate
  modified_base 4: mod_base = OTHER; note = 2'-O-methylguanosine-3'-phosphate
  modified_base 5: mod_base = OTHER; note = 2'-deoxy-2'-fluoroadenosine-3'-phosphate
  modified_base 6: mod_base = OTHER; note = 2'-O-methylcytidine-3'-phosphate
  modified_base 7: mod_base = OTHER; note = 2'-deoxy-2'-fluoroadenosine-3'-phosphate
  modified_base 8: mod_base = OTHER; note = 2'-O-methyluridine-3'-phosphate
  modified_base 9: mod_base = OTHER; note = 2'-deoxy-2'-fluorouridine-3'-phosphate
  modified_base 10: mod_base = OTHER; note = 2'-deoxy-2'-fluorocytidine-3'-phosphate
  modified_base 11: mod_base = OTHER; note = 2'-deoxy-2'-fluoroadenosine-3'-phosphate
  modified_base 12: mod_base = OTHER; note = 2'-O-methylguanosine-3'-phosphate
  modified_base 13: mod_base = OTHER; note = 2'-deoxy-2'-fluoroadenosine-3'-phosphate
  modified_base 14: mod_base = OTHER; note = 2'-O-methyladenosine-3'-phosphate
  modified_base 15: mod_base = OTHER; note = 2'-deoxy-2'-fluorocytidine-3'-phosphate
  modified_base 16: mod_base = OTHER; note = 2'-O-methyladenosine-3'-phosphate
  modified_base 17: mod_base = OTHER; note = 2'-deoxy-2'-fluoroadenosine-3'-phosphate
  modified_base 18: mod_base = OTHER; note = 2'-O-methylguanosine-3'-phosphate
  modified_base 19: mod_base = OTHER; note = 2'-deoxy-2'-fluoroadenosine-3'-phosphate
  modified_base 20: mod_base = OTHER; note = 2'-O-methyladenosine-3'-phosphate
  modified_base 21: mod_base = OTHER; note = 2'-deoxy-2'-fluoroadenosine-3'-phosphate 0
ctggacattcagaacaagaaa

SEQ ID NO: 195 - RNA, 21 nt, synthetic construct
  source 1..21: mol_type = other RNA
  modified_base 1: mod_base = OTHER; note = 2'-deoxy-2'-fluorouridine-3'-phosphorothioate
  modified_base 2: mod_base = OTHER; note = 2'-O-methylguanosine-3'-phosphorothioate
  modified_base 3: mod_base = OTHER; note = 2'-deoxy-2'-fluorouridine-3'-phosphate
  modified_base 4: mod_base = OTHER; note = 2'-O-methylguanosine-3'-phosphate
  modified_base 5: mod_base = OTHER; note = 2'-deoxy-2'-fluoroadenosine-3'-phosphate
  modified_base 6: mod_base = OTHER; note = 2'-O-methylcytidine-3'-phosphate
  modified_base 7: mod_base = OTHER; note = 2'-deoxy-2'-fluoroadenosine-3'-phosphate
  modified_base 8: mod_base = OTHER; note = 2'-O-methyladenosine-3'-phosphate
  modified_base 9: mod_base = OTHER; note = 2'-deoxy-2'-fluoroadenosine-3'-phosphate
  modified_base 10: mod_base = OTHER; note = 2'-deoxy-2'-fluorouridine-3'-phosphate
  modified_base 11: mod_base = OTHER; note = 2'-deoxy-2'-fluoroadenosine-3'-phosphate
  modified_base 12: mod_base = OTHER; note = 2'-O-methyluridine-3'-phosphate
  modified_base 13: mod_base = OTHER; note = 2'-deoxy-2'-fluoroguanosine-3'-phosphate
  modified_base 14: mod_base = OTHER; note = 2'-O-methylguanosine-3'-phosphate
  modified_base 15: mod_base = OTHER; note = 2'-deoxy-2'-fluoroguanosine-3'-phosphate
  modified_base 16: mod_base = OTHER; note = 2'-O-methylcytidine-3'-phosphate
  modified_base 17: mod_base = OTHER; note = 2'-deoxy-2'-fluoroadenosine-3'-phosphate
  modified_base 18: mod_base = OTHER; note = 2'-O-methyluridine-3'-phosphate
  modified_base 19: mod_base = OTHER; note = 2'-deoxy-2'-fluorocytidine-3'-phosphate
  modified_base 20: mod_base = OTHER; note = 2'-O-methyladenosine-3'-phosphate
  modified_base 21: mod_base = OTHER; note = 2'-deoxy-2'-fluoroadenosine-3'-phosphate 0
tgtgacaaatatgggcatcaa

SEQ ID NO: 196 - RNA, 21 nt, synthetic construct
  source 1..21: mol_type = other RNA
  modified_base 1: mod_base = OTHER; note = 2'-deoxy-2'-fluorouridine-3'-phosphorothioate
  modified_base 2: mod_base = OTHER; note = 2'-O-methylguanosine-3'-phosphorothioate
  modified_base 3: mod_base = OTHER; note = 2'-deoxy-2'-fluorouridine-3'-phosphate
  modified_base 4: mod_base = OTHER; note = 2'-O-methylguanosine-3'-phosphate
  modified_base 5: mod_base = OTHER; note = 2'-deoxy-2'-fluoroadenosine-3'-phosphate
  modified_base 6: mod_base = OTHER; note = 2'-O-methylcytidine-3'-phosphate
  modified_base 7: mod_base = OTHER; note = 2'-deoxy-2'-fluoroadenosine-3'-phosphate
  modified_base 8: mod_base = OTHER; note = 2'-O-methyladenosine-3'-phosphate
  modified_base 9: mod_base = OTHER; note = 2'-deoxy-2'-fluoroadenosine-3'-phosphate
  modified_base 10: mod_base = OTHER; note = 2'-deoxy-2'-fluorouridine-3'-phosphate
  modified_base 11: mod_base = OTHER; note = 2'-deoxy-2'-fluoroadenosine-3'-phosphate
  modified_base 12: mod_base = OTHER; note = 2'-O-methyluridine-3'-phosphate
  modified_base 13: mod_base = OTHER; note = 2'-deoxy-2'-fluoroguanosine-3'-phosphate
  modified_base 14: mod_base = OTHER; note = 2'-O-methylguanosine-3'-phosphate
  modified_base 15: mod_base = OTHER; note = 2'-deoxy-2'-fluoroguanosine-3'-phosphate
  modified_base 16: mod_base = OTHER; note = 2'-O-methylcytidine-3'-phosphate
  modified_base 17: mod_base = OTHER; note = 2'-deoxy-2'-fluoroadenosine-3'-phosphate
  modified_base 18: mod_base = OTHER; note = 2'-O-methyluridine-3'-phosphate
  modified_base 19: mod_base = OTHER; note = 2'-deoxy-2'-fluorocytidine-3'-phosphate
  modified_base 20: mod_base = OTHER; note = 2'-O-methyladenosine-3'-phosphate
  modified_base 21: mod_base = OTHER; note = 2'-deoxy-2'-fluoroadenosine-3'-phosphate 0
tgtgacaaatatgggcatcaa

SEQ ID NO: 197 - RNA, 21 nt, synthetic construct
  source 1..21: mol_type = other RNA
  modified_base 1: mod_base = OTHER; note = 2'-deoxy-2'-fluorocytidine-3'-phosphorothioate
  modified_base 2: mod_base = OTHER; note = 2'-O-methylcytidine-3'-phosphorothioate
  modified_base 3: mod_base = OTHER; note = 2'-deoxy-2'-fluorouridine-3'-phosphate
  modified_base 4: mod_base = OTHER; note = 2'-O-methylguanosine-3'-phosphate
  modified_base 5: mod_base = OTHER; note = 2'-deoxy-2'-fluoroguanosine-3'-phosphate
  modified_base 6: mod_base = OTHER; note = 2'-O-methyladenosine-3'-phosphate
  modified_base 7: mod_base = OTHER; note = 2'-deoxy-2'-fluorocytidine-3'-phosphate
  modified_base 8: mod_base = OTHER; note = 2'-O-methyladenosine-3'-phosphate
  modified_base 9: mod_base = OTHER; note = 2'-deoxy-2'-fluorouridine-3'-phosphate
  modified_base 10: mod_base = OTHER; note = 2'-deoxy-2'-fluorouridine-3'-phosphate
  modified_base 11: mod_base = OTHER; note = 2'-deoxy-2'-fluorocytidine-3'-phosphate
  modified_base 12: mod_base = OTHER; note = 2'-O-methyladenosine-3'-phosphate
  modified_base 13: mod_base = OTHER; note = 2'-deoxy-2'-fluoroguanosine-3'-phosphate
  modified_base 14: mod_base = OTHER; note = 2'-O-methyladenosine-3'-phosphate
  modified_base 15: mod_base = OTHER; note = 2'-deoxy-2'-fluoroadenosine-3'-phosphate
  modified_base 16: mod_base = OTHER; note = 2'-O-methylcytidine-3'-phosphate
  modified_base 17: mod_base = OTHER; note = 2'-deoxy-2'-fluoroadenosine-3'-phosphate
  modified_base 18: mod_base = OTHER; note = 2'-O-methyladenosine-3'-phosphate
  modified_base 19: mod_base = OTHER; note = 2'-deoxy-2'-fluoroguanosine-3'-phosphate
  modified_base 20: mod_base = OTHER; note = 2'-O-methyladenosine-3'-phosphate
  modified_base 21: mod_base = OTHER; note = 2'-deoxy-2'-fluoroadenosine-3'-phosphate 0
cctggacattcagaacaagaa

SEQ ID NO: 198 - RNA, 21 nt, synthetic construct
  source 1..21: mol_type = other RNA
  modified_base 1: mod_base = OTHER; note = 2'-deoxy-2'-fluorocytidine-3'-phosphorothioate
  modified_base 2: mod_base = OTHER; note = 2'-O-methylcytidine-3'-phosphorothioate
  modified_base 3: mod_base = OTHER; note = 2'-deoxy-2'-fluorouridine-3'-phosphate
  modified_base 4: mod_base = OTHER; note = 2'-O-methylguanosine-3'-phosphate
  modified_base 5: mod_base = OTHER; note = 2'-deoxy-2'-fluoroguanosine-3'-phosphate
  modified_base 6: mod_base = OTHER; note = 2'-O-methyladenosine-3'-phosphate
  modified_base 7: mod_base = OTHER; note = 2'-deoxy-2'-fluorocytidine-3'-phosphate
  modified_base 8: mod_base = OTHER; note = 2'-O-methyladenosine-3'-phosphate
  modified_base 9: mod_base = OTHER; note = 2'-deoxy-2'-fluorouridine-3'-phosphate
  modified_base 10: mod_base = OTHER; note = 2'-deoxy-2'-fluorouridine-3'-phosphate
  modified_base 11: mod_base = OTHER; note = 2'-deoxy-2'-fluorocytidine-3'-phosphate
  modified_base 12: mod_base = OTHER; note = 2'-O-methyladenosine-3'-phosphate
  modified_base 13: mod_base = OTHER; note = 2'-deoxy-2'-fluoroguanosine-3'-phosphate
  modified_base 14: mod_base = OTHER; note = 2'-O-methyladenosine-3'-phosphate
  modified_base 15: mod_base = OTHER; note = 2'-deoxy-2'-fluoroadenosine-3'-phosphate
  modified_base 16: mod_base = OTHER; note = 2'-O-methylcytidine-3'-phosphate
  modified_base 17: mod_base = OTHER; note = 2'-deoxy-2'-fluoroadenosine-3'-phosphate
  modified_base 18: mod_base = OTHER; note = 2'-O-methyladenosine-3'-phosphate
  modified_base 19: mod_base = OTHER; note = 2'-deoxy-2'-fluoroguanosine-3'-phosphate
  modified_base 20: mod_base = OTHER; note = 2'-O-methyladenosine-3'-phosphate
  modified_base 21: mod_base = OTHER; note = 2'-deoxy-2'-fluoroadenosine-3'-phosphate 0
cctggacattcagaacaagaa

SEQ ID NO: 199 - RNA, 23 nt, synthetic construct
  source 1..23: mol_type = other RNA
  modified_base 1: mod_base = OTHER; note = 2'-O-methyluridine-3'-phosphorothioate
  modified_base 2: mod_base = OTHER; note = 2'-deoxy-2'-fluorouridine-3'-phosphorothioate
  modified_base 3: mod_base = OTHER; note = 2'-O-methyluridine-3'-phosphate
  modified_base 4: mod_base = OTHER; note = 2'-deoxy-2'-fluoroguanosine-3'-phosphate
  modified_base 5: mod_base = OTHER; note = 2'-O-methyladenosine-3'-phosphate
  modified_base 6: mod_base = OTHER; note = 2'-deoxy-2'-fluoroadenosine-3'-phosphate
  modified_base 7: mod_base = OTHER; note = 2'-O-methylguanosine-3'-phosphate
  modified_base 8: mod_base = OTHER; note = 2'-deoxy-2'-fluorocytidine-3'-phosphate
  modified_base 9: mod_base = OTHER; note = 2'-O-methylcytidine-3'-phosphate
  modified_base 10: mod_base = OTHER; note = 2'-deoxy-2'-fluoroadenosine-3'-phosphate
  modified_base 11: mod_base = OTHER; note = 2'-O-methyluridine-3'-phosphate
  modified_base 12: mod_base = OTHER; note = 2'-O-methyladenosine-3'-phosphate
  modified_base 13: mod_base = OTHER; note = 2'-O-methylcytidine-3'-phosphate
  modified_base 14: mod_base = OTHER; note = 2'-deoxy-2'-fluoroadenosine-3'-phosphate
  modified_base 15: mod_base = OTHER; note = 2'-O-methylcytidine-3'-phosphate
  modified_base 16: mod_base = OTHER; note = 2'-deoxy-2'-fluorocytidine-3'-phosphate
  modified_base 17: mod_base = OTHER; note = 2'-O-methyluridine-3'-phosphate
  modified_base 18: mod_base = OTHER; note = 2'-deoxy-2'-fluorocytidine-3'-phosphate
  modified_base 19: mod_base = OTHER; note = 2'-O-methyluridine-3'-phosphate
  modified_base 20: mod_base = OTHER; note = 2'-deoxy-2'-fluorouridine-3'-phosphate
  modified_base 21: mod_base = OTHER; note = 2'-O-methyluridine-3'-phosphorothioate
  modified_base 22: mod_base = OTHER; note = 2'-O-methylcytidine-3'-phosphorothioate
  modified_base 23: mod_base = OTHER; note = 2'-O-methyladenosine
tttgaagccatacacctctttca

SEQ ID NO: 200 - RNA, 23 nt, synthetic construct
  source 1..23: mol_type = other RNA
  modified_base 1: mod_base = OTHER; note = 2'-O-methyluridine-3'-phosphorothioate 5'-(E)-Vinylphosphonate
  modified_base 2: mod_base = OTHER; note = 2'-deoxy-2'-fluorouridine-3'-phosphorothioate
  modified_base 3: mod_base = OTHER; note = 2'-O-methyluridine-3'-phosphate
  modified_base 4: mod_base = OTHER; note = 2'-deoxy-2'-fluoroguanosine-3'-phosphate
  modified_base 5: mod_base = OTHER; note = 2'-O-methyladenosine-3'-phosphate
  modified_base 6: mod_base = OTHER; note = 2'-deoxy-2'-fluoroadenosine-3'-phosphate
  modified_base 7: mod_base = OTHER; note = 2'-O-methylguanosine-3'-phosphate
  modified_base 8: mod_base = OTHER; note = 2'-deoxy-2'-fluorocytidine-3'-phosphate
  modified_base 9: mod_base = OTHER; note = 2'-O-methylcytidine-3'-phosphate
  modified_base 10: mod_base = OTHER; note = 2'-deoxy-2'-fluoroadenosine-3'-phosphate
  modified_base 11: mod_base = OTHER; note = 2'-O-methyluridine-3'-phosphate
  modified_base 12: mod_base = OTHER; note = 2'-O-methyladenosine-3'-phosphate
  modified_base 13: mod_base = OTHER; note = 2'-O-methylcytidine-3'-phosphate
  modified_base 14: mod_base = OTHER; note = 2'-deoxy-2'-fluoroadenosine-3'-phosphate
  modified_base 15: mod_base = OTHER; note = 2'-O-methylcytidine-3'-phosphate
  modified_base 16: mod_base = OTHER; note = 2'-deoxy-2'-fluorocytidine-3'-phosphate
  modified_base 17: mod_base = OTHER; note = 2'-O-methyluridine-3'-phosphate
  modified_base 18: mod_base = OTHER; note = 2'-deoxy-2'-fluorocytidine-3'-phosphate
  modified_base 19: mod_base = OTHER; note = 2'-O-methyluridine-3'-phosphate
  modified_base 20: mod_base = OTHER; note = 2'-deoxy-2'-fluorouridine-3'-phosphate
  modified_base 21: mod_base = OTHER; note = 2'-O-methyluridine-3'-phosphorothioate
  modified_base 22: mod_base = OTHER; note = 2'-O-methylcytidine-3'-phosphorothioate
  modified_base 23: mod_base = OTHER; note = 2'-O-methyladenosine
tttgaagccatacacctctttca

SEQ ID NO: 201 - RNA, 23 nt, synthetic construct
  source 1..23: mol_type = other RNA
  modified_base 1: mod_base = OTHER; note = 2'-O-methyluridine-3'-phosphorothioate
  modified_base 2: mod_base = OTHER; note = 2'-deoxy-2'-fluorouridine-3'-phosphorothioate
  modified_base 3: mod_base = OTHER; note = 2'-O-methyluridine-3'-phosphate
  modified_base 4: mod_base = OTHER; note = 2'-deoxy-2'-fluorocytidine-3'-phosphate
  modified_base 5: mod_base = OTHER; note = 2'-O-methyluridine-3'-phosphate
  modified_base 6: mod_base = OTHER; note = 2'-deoxy-2'-fluorouridine-3'-phosphate
  modified_base 7: mod_base = OTHER; note = 2'-O-methylguanosine-3'-phosphate
  modified_base 8: mod_base = OTHER; note = 2'-deoxy-2'-fluorouridine-3'-phosphate
  modified_base 9: mod_base = OTHER; note = 2'-O-methyluridine-3'-phosphate
  modified_base 10: mod_base = OTHER; note = 2'-deoxy-2'-fluorocytidine-3'-phosphate
  modified_base 11: mod_base = OTHER; note = 2'-O-methyluridine-3'-phosphate
  modified_base 12: mod_base = OTHER; note = 2'-O-methylguanosine-3'-phosphate
  modified_base 13: mod_base = OTHER; note = 2'-O-methyladenosine-3'-phosphate
  modified_base 14: mod_base = OTHER; note = 2'-deoxy-2'-fluoroadenosine-3'-phosphate
  modified_base 15: mod_base = OTHER; note = 2'-O-methyluridine-3'-phosphate
  modified_base 16: mod_base = OTHER; note = 2'-deoxy-2'-fluoroguanosine-3'-phosphate
  modified_base 17: mod_base = OTHER; note = 2'-O-methyluridine-3'-phosphate
  modified_base 18: mod_base = OTHER; note = 2'-deoxy-2'-fluorocytidine-3'-phosphate
  modified_base 19: mod_base = OTHER; note = 2'-O-methylcytidine-3'-phosphate
  modified_base 20: mod_base = OTHER; note = 2'-deoxy-2'-fluoroadenosine-3'-phosphate
  modified_base 21: mod_base = OTHER; note = 2'-O-methylguanosine-3'-phosphorothioate
  modified_base 22: mod_base = OTHER; note = 2'-O-methylguanosine-3'-phosphorothioate
  modified_base 23: mod_base = OTHER; note = 2'-O-methylguanosine
tttcttgttctgaatgtccaggg

SEQ ID NO: 202 - RNA, 23 nt, synthetic construct
  source 1..23: mol_type = other RNA
  modified_base 1: mod_base = OTHER; note = 2'-O-methyluridine-3'-phosphorothioate 5'-(E)-Vinylphosphonate
  modified_base 2: mod_base = OTHER; note = 2'-deoxy-2'-fluorouridine-3'-phosphorothioate
  modified_base 3: mod_base = OTHER; note = 2'-O-methyluridine-3'-phosphate
  modified_base 4: mod_base = OTHER; note = 2'-deoxy-2'-fluorocytidine-3'-phosphate
  modified_base 5: mod_base = OTHER; note = 2'-O-methyluridine-3'-phosphate
  modified_base 6: mod_base = OTHER; note = 2'-deoxy-2'-fluorouridine-3'-phosphate
  modified_base 7: mod_base = OTHER; note = 2'-O-methylguanosine-3'-phosphate
  modified_base 8: mod_base = OTHER; note = 2'-deoxy-2'-fluorouridine-3'-phosphate
  modified_base 9: mod_base = OTHER; note = 2'-O-methyluridine-3'-phosphate
  modified_base 10: mod_base = OTHER; note = 2'-deoxy-2'-fluorocytidine-3'-phosphate
  modified_base 11: mod_base = OTHER; note = 2'-O-methyluridine-3'-phosphate
  modified_base 12: mod_base = OTHER; note = 2'-O-methylguanosine-3'-phosphate
  modified_base 13: mod_base = OTHER; note = 2'-O-methyladenosine-3'-phosphate
  modified_base 14: mod_base = OTHER; note = 2'-deoxy-2'-fluoroadenosine-3'-phosphate
  modified_base 15: mod_base = OTHER; note = 2'-O-methyluridine-3'-phosphate
  modified_base 16: mod_base = OTHER; note = 2'-deoxy-2'-fluoroguanosine-3'-phosphate
  modified_base 17: mod_base = OTHER; note = 2'-O-methyluridine-3'-phosphate
  modified_base 18: mod_base = OTHER; note = 2'-deoxy-2'-fluorocytidine-3'-phosphate
  modified_base 19: mod_base = OTHER; note = 2'-O-methylcytidine-3'-phosphate
  modified_base 20: mod_base = OTHER; note = 2'-deoxy-2'-fluoroadenosine-3'-phosphate
  modified_base 21: mod_base = OTHER; note = 2'-O-methylguanosine-3'-phosphorothioate
  modified_base 22: mod_base = OTHER; note = 2'-O-methylguanosine-3'-phosphorothioate
  modified_base 23: mod_base = OTHER; note = 2'-O-methylguanosine
tttcttgttctgaatgtccaggg

SEQ ID NO: 203 - RNA, 23 nt, synthetic construct
  source 1..23: mol_type = other RNA
  modified_base 1: mod_base = OTHER; note = 2'-O-methyluridine-3'-phosphorothioate
  modified_base 2: mod_base = OTHER; note = 2'-deoxy-2'-fluorouridine-3'-phosphorothioate
  modified_base 3: mod_base = OTHER; note = 2'-O-methylguanosine-3'-phosphate
  modified_base 4: mod_base = OTHER; note = 2'-deoxy-2'-fluoroadenosine-3'-phosphate
  modified_base 5: mod_base = OTHER; note = 2'-O-methyluridine-3'-phosphate
  modified_base 6: mod_base = OTHER; note = 2'-deoxy-2'-fluoroguanosine-3'-phosphate
  modified_base 7: mod_base = OTHER; note = 2'-O-methylcytidine-3'-phosphate
  modified_base 8: mod_base = OTHER; note = 2'-deoxy-2'-fluorocytidine-3'-phosphate
  modified_base 9: mod_base = OTHER; note = 2'-O-methylcytidine-3'-phosphate
  modified_base 10: mod_base = OTHER; note = 2'-deoxy-2'-fluoroadenosine-3'-phosphate
  modified_base 11: mod_base = OTHER; note = 2'-O-methyluridine-3'-phosphate
  modified_base 12: mod_base = OTHER; note = 2'-O-methyladenosine-3'-phosphate
  modified_base 13: mod_base = OTHER; note = 2'-O-methyluridine-3'-phosphate
  modified_base 14: mod_base = OTHER; note = 2'-deoxy-2'-fluorouridine-3'-phosphate
  modified_base 15: mod_base = OTHER; note = 2'-O-methyluridine-3'-phosphate
  modified_base 16: mod_base = OTHER; note = 2'-deoxy-2'-fluoroguanosine-3'-phosphate
  modified_base 17: mod_base = OTHER; note = 2'-O-methyluridine-3'-phosphate
  modified_base 18: mod_base = OTHER; note = 2'-deoxy-2'-fluorocytidine-3'-phosphate
  modified_base 19: mod_base = OTHER; note = 2'-O-methyladenosine-3'-phosphate
  modified_base 20: mod_base = OTHER; note = 2'-deoxy-2'-fluorocytidine-3'-phosphate
  modified_base 21: mod_base = OTHER; note = 2'-O-methyladenosine-3'-phosphorothioate
  modified_base 22: mod_base = OTHER; note = 2'-O-methyladenosine-3'-phosphorothioate
  modified_base 23: mod_base = OTHER; note = 2'-O-methyladenosine
ttgatgcccatatttgtcacaaa

SEQ ID NO: 204 - RNA, 23 nt, synthetic construct
  source 1..23: mol_type = other RNA
  modified_base 1: mod_base = OTHER; note = 2'-O-methyluridine-3'-phosphorothioate 5'-(E)-Vinylphosphonate
  modified_base 2: mod_base = OTHER; note = 2'-deoxy-2'-fluorouridine-3'-phosphorothioate
  modified_base 3: mod_base = OTHER; note = 2'-O-methylguanosine-3'-phosphate
  modified_base 4: mod_base = OTHER; note = 2'-deoxy-2'-fluoroadenosine-3'-phosphate
  modified_base 5: mod_base = OTHER; note = 2'-O-methyluridine-3'-phosphate
  modified_base 6: mod_base = OTHER; note = 2'-deoxy-2'-fluoroguanosine-3'-phosphate
  modified_base 7: mod_base = OTHER; note = 2'-O-methylcytidine-3'-phosphate
  modified_base 8: mod_base = OTHER; note = 2'-deoxy-2'-fluorocytidine-3'-phosphate
  modified_base 9: mod_base = OTHER; note = 2'-O-methylcytidine-3'-phosphate
  modified_base 10: mod_base = OTHER; note = 2'-deoxy-2'-fluoroadenosine-3'-phosphate
  modified_base 11: mod_base = OTHER; note = 2'-O-methyluridine-3'-phosphate
  modified_base 12: mod_base = OTHER; note = 2'-O-methyladenosine-3'-phosphate
  modified_base 13: mod_base = OTHER; note = 2'-O-methyluridine-3'-phosphate
  modified_base 14: mod_base = OTHER; note = 2'-deoxy-2'-fluorouridine-3'-phosphate
  modified_base 15: mod_base = OTHER; note = 2'-O-methyluridine-3'-phosphate
  modified_base 16: mod_base = OTHER; note = 2'-deoxy-2'-fluoroguanosine-3'-phosphate
  modified_base 17: mod_base = OTHER; note = 2'-O-methyluridine-3'-phosphate
  modified_base 18: mod_base = OTHER; note = 2'-deoxy-2'-fluorocytidine-3'-phosphate
  modified_base 19: mod_base = OTHER; note = 2'-O-methyladenosine-3'-phosphate
  modified_base 20: mod_base = OTHER; note = 2'-deoxy-2'-fluorocytidine-3'-phosphate
  modified_base 21: mod_base = OTHER; note = 2'-O-methyladenosine-3'-phosphorothioate
  modified_base 22: mod_base = OTHER; note = 2'-O-methyladenosine-3'-phosphorothioate
  modified_base 23: mod_base = OTHER; note = 2'-O-methyladenosine
ttgatgcccatatttgtcacaaa

SEQ ID NO: 205 - RNA, 23 nt, synthetic construct
  source 1..23: mol_type = other RNA
  modified_base 1: mod_base = OTHER; note = 2'-O-methyluridine-3'-phosphorothioate
  modified_base 2: mod_base = OTHER; note = 2'-deoxy-2'-fluorouridine-3'-phosphorothioate
  modified_base 3: mod_base = OTHER; note = 2'-O-methylcytidine-3'-phosphate
  modified_base 4: mod_base = OTHER; note = 2'-deoxy-2'-fluorouridine-3'-phosphate
  modified_base 5: mod_base = OTHER; note = 2'-O-methyluridine-3'-phosphate
  modified_base 6: mod_base = OTHER; note = 2'-deoxy-2'-fluoroguanosine-3'-phosphate
  modified_base 7: mod_base = OTHER; note = 2'-O-methyluridine-3'-phosphate
  modified_base 8: mod_base = OTHER; note = 2'-deoxy-2'-fluorouridine-3'-phosphate
  modified_base 9: mod_base = OTHER; note = 2'-O-methylcytidine-3'-phosphate
  modified_base 10: mod_base = OTHER; note = 2'-deoxy-2'-fluorouridine-3'-phosphate
  modified_base 11: mod_base = OTHER; note = 2'-O-methylguanosine-3'-phosphate
  modified_base 12: mod_base = OTHER; note = 2'-O-methyladenosine-3'-phosphate
  modified_base 13: mod_base = OTHER; note = 2'-O-methyladenosine-3'-phosphate
  modified_base 14: mod_base = OTHER; note = 2'-deoxy-2'-fluorouridine-3'-phosphate
  modified_base 15: mod_base = OTHER; note = 2'-O-methylguanosine-3'-phosphate
  modified_base 16: mod_base = OTHER; note = 2'-deoxy-2'-fluorouridine-3'-phosphate
  modified_base 17: mod_base = OTHER; note = 2'-O-methylcytidine-3'-phosphate
  modified_base 18: mod_base = OTHER; note = 2'-deoxy-2'-fluorocytidine-3'-phosphate
  modified_base 19: mod_base = OTHER; note = 2'-O-methyladenosine-3'-phosphate
  modified_base 20: mod_base = OTHER; note = 2'-deoxy-2'-fluoroguanosine-3'-phosphate
  modified_base 21: mod_base = OTHER; note = 2'-O-methylguanosine-3'-phosphorothioate
  modified_base 22: mod_base = OTHER; note = 2'-O-methylguanosine-3'-phosphorothioate
  modified_base 23: mod_base = OTHER; note = 2'-O-methyluridine
ttcttgttctgaatgtccagggt

SEQ ID NO: 206 - RNA, 23 nt, synthetic construct
  source 1..23: mol_type = other RNA
  modified_base 1: mod_base = OTHER; note = 2'-O-methyluridine-3'-phosphorothioate 5'-(E)-Vinylphosphonate
  modified_base 2: mod_base = OTHER; note = 2'-deoxy-2'-fluorouridine-3'-phosphorothioate
  modified_base 3: mod_base = OTHER; note = 2'-O-methylcytidine-3'-phosphate
  modified_base 4: mod_base = OTHER; note = 2'-deoxy-2'-fluorouridine-3'-phosphate
  modified_base 5: mod_base = OTHER; note = 2'-O-methyluridine-3'-phosphate
  modified_base 6: mod_base = OTHER; note = 2'-deoxy-2'-fluoroguanosine-3'-phosphate
  modified_base 7: mod_base = OTHER; note = 2'-O-methyluridine-3'-phosphate
  modified_base 8: mod_base = OTHER; note = 2'-deoxy-2'-fluorouridine-3'-phosphate
  modified_base 9: mod_base = OTHER; note = 2'-O-methylcytidine-3'-phosphate
  modified_base 10: mod_base = OTHER; note = 2'-deoxy-2'-fluorouridine-3'-phosphate
  modified_base 11: mod_base = OTHER; note = 2'-O-methylguanosine-3'-phosphate
  modified_base 12: mod_base = OTHER; note = 2'-O-methyladenosine-3'-phosphate
  modified_base 13: mod_base = OTHER; note = 2'-O-methyladenosine-3'-phosphate
  modified_base 14: mod_base = OTHER; note = 2'-deoxy-2'-fluorouridine-3'-phosphate
  modified_base 15: mod_base = OTHER; note = 2'-O-methylguanosine-3'-phosphate
  modified_base 16: mod_base = OTHER; note = 2'-deoxy-2'-fluorouridine-3'-phosphate
  modified_base 17: mod_base = OTHER; note = 2'-O-methylcytidine-3'-phosphate
  modified_base 18: mod_base = OTHER; note = 2'-deoxy-2'-fluorocytidine-3'-phosphate
  modified_base 19: mod_base = OTHER; note = 2'-O-methyladenosine-3'-phosphate
  modified_base 20: mod_base = OTHER; note = 2'-deoxy-2'-fluoroguanosine-3'-phosphate
  modified_base 21: mod_base = OTHER; note = 2'-O-methylguanosine-3'-phosphorothioate
  modified_base 22: mod_base = OTHER; note = 2'-O-methylguanosine-3'-phosphorothioate
  modified_base 23: mod_base = OTHER; note = 2'-O-methyluridine
ttcttgttctgaatgtccagggt

SEQ ID NO: 207 - RNA, 21 nt, synthetic construct
  source 1..21: mol_type = other RNA
  modified_base 1: mod_base = OTHER; note = 2'-O-methyluridine-3'-phosphorothioate
  modified_base 2: mod_base = OTHER; note = 2'-O-methylguanosine-3'-phosphorothioate
  modified_base 3: mod_base = OTHER; note = 2'-O-methylguanosine-3'-phosphate
  modified_base 4: mod_base = OTHER; note = 2'-O-methyladenosine-3'-phosphate
  modified_base 5: mod_base = OTHER; note = 2'-O-methyladenosine-3'-phosphate
  modified_base 6: mod_base = OTHER; note = 2'-O-methylguanosine-3'-phosphate
  modified_base 7: mod_base = OTHER; note = 2'-deoxy-2'-fluorocytidine-3'-phosphate
  modified_base 8: mod_base = OTHER; note = 2'-O-methyladenosine-3'-phosphate
  modified_base 9: mod_base = OTHER; note = 2'-deoxy-2'-fluoroguanosine-3'-phosphate
  modified_base 10: mod_base = OTHER; note = 2'-deoxy-2'-fluorouridine-3'-phosphate
  modified_base 11: mod_base = OTHER; note = 2'-deoxy-2'-fluoroadenosine-3'-phosphate
  modified_base 12: mod_base = OTHER; note = 2'-O-methyluridine-3'-phosphate
  modified_base 13: mod_base = OTHER; note = 2'-O-methylguanosine-3'-phosphate
  modified_base 14: mod_base = OTHER; note = 2'-O-methyluridine-3'-phosphate
  modified_base 15: mod_base = OTHER; note = 2'-O-methyluridine-3'-phosphate
  modified_base 16: mod_base = OTHER; note = 2'-O-methylguanosine-3'-phosphate
  modified_base 17: mod_base = OTHER; note = 2'-O-methyladenosine-3'-phosphate
  modified_base 18: mod_base = OTHER; note = 2'-O-methyluridine-3'-phosphate
  modified_base 19: mod_base = OTHER; note = 2'-O-methylguanosine-3'-phosphate
  modified_base 20: mod_base = OTHER; note = 2'-O-methylguanosine-3'-phosphate
  modified_base 21: mod_base = OTHER; note = 2'-O-methyladenosine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
tggaagcagtatgttgatgga

SEQ ID NO: 208 - RNA, 21 nt, synthetic construct
  source 1..21: mol_type = other RNA
  modified_base 1: mod_base = OTHER; note = 2'-O-methyluridine-3'-phosphorothioate
  modified_base 2: mod_base = OTHER; note = 2'-O-methylguanosine-3'-phosphorothioate
  modified_base 3: mod_base = OTHER; note = 2'-O-methylguanosine-3'-phosphate
  modified_base 4: mod_base = OTHER; note = 2'-O-methyladenosine-3'-phosphate
  modified_base 5: mod_base = OTHER; note = 2'-O-methyladenosine-3'-phosphate
  modified_base 6: mod_base = OTHER; note = 2'-O-methylguanosine-3'-phosphate
  modified_base 7: mod_base = OTHER; note = 2'-deoxy-2'-fluorocytidine-3'-phosphate
  modified_base 8: mod_base = OTHER; note = 2'-O-methyladenosine-3'-phosphate
  modified_base 9: mod_base = OTHER; note = 2'-deoxy-2'-fluoroguanosine-3'-phosphate
  modified_base 10: mod_base = OTHER; note = 2'-deoxy-2'-fluorouridine-3'-phosphate
  modified_base 11: mod_base = OTHER; note = 2'-deoxy-2'-fluoroadenosine-3'-phosphate
  modified_base 12: mod_base = OTHER; note = 2'-O-methyluridine-3'-phosphate
  modified_base 13: mod_base = OTHER; note = 2'-O-methylguanosine-3'-phosphate
  modified_base 14: mod_base = OTHER; note = 2'-O-methyluridine-3'-phosphate
  modified_base 15: mod_base = OTHER; note = 2'-O-methyluridine-3'-phosphate
  modified_base 16: mod_base = OTHER; note = 2'-O-methylguanosine-3'-phosphate
  modified_base 17: mod_base = OTHER; note = 2'-O-methyladenosine-3'-phosphate
  modified_base 18: mod_base = OTHER; note = 2'-O-methyluridine-3'-phosphate
  modified_base 19: mod_base = OTHER; note = 2'-O-methylguanosine-3'-phosphate
  modified_base 20: mod_base = OTHER; note = 2'-O-methylguanosine-3'-phosphate
  modified_base 21: mod_base = OTHER; note = 2'-O-methyladenosine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
tggaagcagtatgttgatgga

SEQ ID NO: 209 - RNA, 21 nt, synthetic construct
  source 1..21: mol_type = other RNA
  modified_base 1: mod_base = OTHER; note = 2'-O-methyluridine-3'-phosphorothioate
  modified_base 2: mod_base = OTHER; note = 2'-O-methylguanosine-3'-phosphorothioate
  modified_base 3: mod_base = OTHER; note = 2'-O-methylguanosine-3'-phosphate
  modified_base 4: mod_base = OTHER; note = 2'-O-methyladenosine-3'-phosphate
  modified_base 5: mod_base = OTHER; note = 2'-O-methyladenosine-3'-phosphate
  modified_base 6: mod_base = OTHER; note = 2'-O-methylguanosine-3'-phosphate
  modified_base 7: mod_base = OTHER; note = 2'-deoxy-2'-fluorocytidine-3'-phosphate
  modified_base 8: mod_base = OTHER; note = 2'-O-methyladenosine-3'-phosphate
  modified_base 9: mod_base = OTHER; note = 2'-deoxy-2'-fluoroguanosine-3'-phosphate
  modified_base 10: mod_base = OTHER; note = 2'-deoxy-2'-fluorouridine-3'-phosphate
  modified_base 11: mod_base = OTHER; note = 2'-deoxy-2'-fluoroadenosine-3'-phosphate
  modified_base 12: mod_base = OTHER; note = 2'-O-methyluridine-3'-phosphate
  modified_base 13: mod_base = OTHER; note = 2'-O-methylguanosine-3'-phosphate
  modified_base 14: mod_base = OTHER; note = 2'-O-methyluridine-3'-phosphate
  modified_base 15: mod_base = OTHER; note = 2'-O-methyluridine-3'-phosphate
  modified_base 16: mod_base = OTHER; note = 2'-O-methylguanosine-3'-phosphate
  modified_base 17: mod_base = OTHER; note = 2'-O-methyladenosine-3'-phosphate
  modified_base 18: mod_base = OTHER; note = 2'-O-methyluridine-3'-phosphate
  modified_base 19: mod_base = OTHER; note = 2'-O-methylguanosine-3'-phosphate
  modified_base 20: mod_base = OTHER; note = 2'-O-methylguanosine-3'-phosphate
  modified_base 21: mod_base = OTHER; note = 2'-O-methyladenosine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
tggaagcagtatgttgatgga

SEQ ID NO: 210 - RNA, 21 nt, synthetic construct
  source 1..21: mol_type = other RNA
  modified_base 1: mod_base = OTHER; note = 2'-O-methyluridine-3'-phosphorothioate
  modified_base 2: mod_base = OTHER; note = 2'-O-methylguanosine-3'-phosphorothioate
  modified_base 3: mod_base = OTHER; note = 2'-O-methylguanosine-3'-phosphate
  modified_base 4: mod_base = OTHER; note = 2'-O-methyladenosine-3'-phosphate
  modified_base 5: mod_base = OTHER; note = 2'-O-methyladenosine-3'-phosphate
  modified_base 6: mod_base = OTHER; note = 2'-O-methylguanosine-3'-phosphate
  modified_base 7: mod_base = OTHER; note = 2'-deoxy-2'-fluorocytidine-3'-phosphate
  modified_base 8: mod_base = OTHER; note = 2'-O-methyladenosine-3'-phosphate
  modified_base 9: mod_base = OTHER; note = 2'-deoxy-2'-fluoroguanosine-3'-phosphate
  modified_base 10: mod_base = OTHER; note = 2'-deoxy-2'-fluorouridine-3'-phosphate
  modified_base 11: mod_base = OTHER; note = 2'-deoxy-2'-fluoroadenosine-3'-phosphate
  modified_base 12: mod_base = OTHER; note = 2'-O-methyluridine-3'-phosphate
  modified_base 13: mod_base = OTHER; note = 2'-O-methylguanosine-3'-phosphate
  modified_base 14: mod_base = OTHER; note = 2'-O-methyluridine-3'-phosphate
  modified_base 15: mod_base = OTHER; note = 2'-O-methyluridine-3'-phosphate
  modified_base 16: mod_base = OTHER; note = 2'-O-methylguanosine-3'-phosphate
  modified_base 17: mod_base = OTHER; note = 2'-O-methyladenosine-3'-phosphate
  modified_base 18: mod_base = OTHER; note = 2'-O-methyluridine-3'-phosphate
  modified_base 19: mod_base = OTHER; note = 2'-O-methylguanosine-3'-phosphate
  modified_base 20: mod_base = OTHER; note = 2'-O-methylguanosine-3'-phosphate
  modified_base 21: mod_base = OTHER; note = 2'-O-methyladenosine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
tggaagcagtatgttgatgga

SEQ ID NO: 211 - RNA, 23 nt, synthetic construct
  source 1..23: mol_type = other RNA
  modified_base 1: mod_base = OTHER; note = 2'-O-methyluridine-3'-phosphorothioate
  modified_base 2: mod_base = OTHER; note = 2'-deoxy-2'-fluorocytidine-3'-phosphorothioate
  modified_base 3: mod_base = OTHER; note = 2'-O-methylcytidine-3'-phosphate
  modified_base 4: mod_base = OTHER; note = 2'-O-methyladenosine-3'-phosphate
  modified_base 5: mod_base = OTHER; note = 2'-O-methyluridine-3'-phosphate
  modified_base 6: mod_base = OTHER; note = 2'-deoxy-2'-fluorocytidine-3'-phosphate
  modified_base 7: mod_base = OTHER; note = 2'-O-methyladenosine-3'-phosphate
  modified_base 8: mod_base = OTHER; note = 2'-deoxy-2'-fluoroadenosine-3'-phosphate
  modified_base 9: mod_base = OTHER; note = 2'-deoxy-2'-fluorocytidine-3'-phosphate
  modified_base 10: mod_base = OTHER; note = 2'-O-methyladenosine-3'-phosphate
  modified_base 11: mod_base = OTHER; note = 2'-O-methyluridine-3'-phosphate
  modified_base 12: mod_base = OTHER; note = 2'-O-methyladenosine-3'-phosphate
  modified_base 13: mod_base = OTHER; note = 2'-O-methylcytidine-3'-phosphate
  modified_base 14: mod_base = OTHER; note = 2'-deoxy-2'-fluorouridine-3'-phosphate
  modified_base 15: mod_base = OTHER; note = 2'-O-methylguanosine-3'-phosphate
  modified_base 16: mod_base = OTHER; note = 2'-deoxy-2'-fluorocytidine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methylcytidine-3'-phosphate
  modified_base 20: mod_base = OTHER; note = 2'-O-methylcytidine-3'-phosphate
  modified_base 21: mod_base = OTHER; note = 2'-O-methyladenosine-3'-phosphorothioate
  modified_base 22: mod_base = OTHER; note = 2'-O-methyladenosine-3'-phosphorothioate
  modified_base 23: mod_base = OTHER; note = 2'-O-methyladenosine
tccatcaacatactgcttccaaa

SEQ ID NO: 212 - RNA, 23 nt, synthetic construct
  source 1..23: mol_type = other RNA
  modified_base 1: mod_base = OTHER; note = 2'-O-methyluridine-3'-phosphate 5'-(E)-Vinylphosphonate
  modified_base 2: mod_base = OTHER; note = 2'-deoxy-2'-fluorocytidine-3'-phosphate
  modified_base 3: mod_base = OTHER; note = 2'-O-methylcytidine-3'-phosphate
  modified_base 4: mod_base = OTHER; note = 2'-O-methyladenosine-3'-phosphate
  modified_base 5: mod_base = OTHER; note = 2'-O-methyluridine-3'-phosphate
  modified_base 6: mod_base = OTHER; note = 2'-deoxy-2'-fluorocytidine-3'-phosphate
  modified_base 7: mod_base = OTHER; note = 2'-O-methyladenosine-3'-phosphate
  modified_base 8: mod_base = OTHER; note = 2'-deoxy-2'-fluoroadenosine-3'-phosphate
  modified_base 9: mod_base = OTHER; note = 2'-deoxy-2'-fluorocytidine-3'-phosphate
  modified_base 10: mod_base = OTHER; note = 2'-O-methyladenosine-3'-phosphate
  modified_base 11: mod_base = OTHER; note = 2'-O-methyluridine-3'-phosphate
  modified_base 12: mod_base = OTHER; note = 2'-O-methyladenosine-3'-phosphate
  modified_base 13: mod_base = OTHER; note = 2'-O-methylcytidine-3'-phosphate
  modified_base 14: mod_base = OTHER; note = 2'-deoxy-2'-fluorouridine-3'-phosphate
  modified_base 15: mod_base = OTHER; note = 2'-O-methylguanosine-3'-phosphate
  modified_base 16: mod_base = OTHER; note = 2'-deoxy-2'-fluorocytidine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methylcytidine-3'-phosphate
  modified_base 20: mod_base = OTHER; note = 2'-O-methylcytidine-3'-phosphate
  modified_base 21: mod_base = OTHER; note = 2'-O-methyladenosine-3'-phosphorothioate
  modified_base 22: mod_base = OTHER; note = 2'-O-methyladenosine-3'-phosphorothioate
  modified_base 23: mod_base = OTHER; note = 2'-O-methyladenosine
tccatcaacatactgcttccaaa

SEQ ID NO: 213 - RNA, 23 nt, synthetic construct
  source 1..23: mol_type = other RNA
  modified_base 1: mod_base = OTHER; note = 2'-deoxy-2'-fluorouridine-3'-phosphate 5'-(E)-Vinylphosphonate
  modified_base 2: mod_base = OTHER; note = 2'-deoxy-2'-fluorocytidine-3'-phosphate
  modified_base 3: mod_base = OTHER; note = 2'-O-methylcytidine-3'-phosphate
  modified_base 4: mod_base = OTHER; note = 2'-O-methyladenosine-3'-phosphate
  modified_base 5: mod_base = OTHER; note = 2'-O-methyluridine-3'-phosphate
  modified_base 6: mod_base = OTHER; note = 2'-deoxy-2'-fluorocytidine-3'-phosphate
  modified_base 7: mod_base = OTHER; note = 2'-O-methyladenosine-3'-phosphate
  modified_base 8: mod_base = OTHER; note = 2'-deoxy-2'-fluoroadenosine-3'-phosphate
  modified_base 9: mod_base = OTHER; note = 2'-deoxy-2'-fluorocytidine-3'-phosphate
  modified_base 10: mod_base = OTHER; note = 2'-O-methyladenosine-3'-phosphate
  modified_base 11: mod_base = OTHER; note = 2'-O-methyluridine-3'-phosphate
  modified_base 12: mod_base = OTHER; note = 2'-O-methyladenosine-3'-phosphate
  modified_base 13: mod_base = OTHER; note = 2'-O-methylcytidine-3'-phosphate
  modified_base 14: mod_base = OTHER; note = 2'-deoxy-2'-fluorouridine-3'-phosphate
  modified_base 15: mod_base = OTHER; note = 2'-O-methylguanosine-3'-phosphate
  modified_base 16: mod_base = OTHER; note = 2'-deoxy-2'-fluorocytidine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methylcytidine-3'-phosphate
  modified_base 20: mod_base = OTHER; note = 2'-O-methylcytidine-3'-phosphate
  modified_base 21: mod_base = OTHER; note = 2'-O-methyladenosine-3'-phosphorothioate
  modified_base 22: mod_base = OTHER; note = 2'-O-methyladenosine-3'-phosphorothioate
  modified_base 23: mod_base = OTHER; note = 2'-O-methyladenosine
tccatcaacatactgcttccaaa

SEQ ID NO: 214 - RNA, 23 nt, synthetic construct
  source 1..23: mol_type = other RNA
  modified_base 1: mod_base = OTHER; note = 2'-O-(N-methylacetamide)thymidine-3'-phosphate 5'-(E)-Vinylphosphonate
  modified_base 2: mod_base = OTHER; note = 2'-deoxy-2'-fluorocytidine-3'-phosphate
  modified_base 3: mod_base = OTHER; note = 2'-O-methylcytidine-3'-phosphate
  modified_base 4: mod_base = OTHER; note = 2'-O-methyladenosine-3'-phosphate
  modified_base 5: mod_base = OTHER; note = 2'-O-methyluridine-3'-phosphate
  modified_base 6: mod_base = OTHER; note = 2'-deoxy-2'-fluorocytidine-3'-phosphate
  modified_base 7: mod_base = OTHER; note = 2'-O-methyladenosine-3'-phosphate
  modified_base 8: mod_base = OTHER; note = 2'-deoxy-2'-fluoroadenosine-3'-phosphate
  modified_base 9: mod_base = OTHER; note = 2'-deoxy-2'-fluorocytidine-3'-phosphate
  modified_base 10: mod_base = OTHER; note = 2'-O-methyladenosine-3'-phosphate
  modified_base 11: mod_base = OTHER; note = 2'-O-methyluridine-3'-phosphate
  modified_base 12: mod_base = OTHER; note = 2'-O-methyladenosine-3'-phosphate
  modified_base 13: mod_base = OTHER; note = 2'-O-methylcytidine-3'-phosphate
  modified_base 14: mod_base = OTHER; note = 2'-deoxy-2'-fluorouridine-3'-phosphate
  modified_base 15: mod_base = OTHER; note = 2'-O-methylguanosine-3'-phosphate
  modified_base 16: mod_base = OTHER; note = 2'-deoxy-2'-fluorocytidine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methylcytidine-3'-phosphate
  modified_base 20: mod_base = OTHER; note = 2'-O-methylcytidine-3'-phosphate
  modified_base 21: mod_base = OTHER; note = 2'-O-methyladenosine-3'-phosphorothioate
  modified_base 22: mod_base = OTHER; note = 2'-O-methyladenosine-3'-phosphorothioate
  modified_base 23: mod_base = OTHER; note = 2'-O-methyladenosine
tccatcaacatactgcttccaaa

SEQ ID NO: 215 - RNA, 21 nt, synthetic construct
  source 1..21: mol_type = other RNA
  modified_base 1: mod_base = OTHER; note = 2'-deoxy-2'-fluorocytidine-3'-phosphorothioate
  modified_base 2: mod_base = OTHER; note = 2'-O-methylcytidine-3'-phosphorothioate
  modified_base 3: mod_base = OTHER; note = 2'-deoxy-2'-fluorouridine-3'-phosphate
  modified_base 4: mod_base = OTHER; note = 2'-O-methylguanosine-3'-phosphate
  modified_base 5: mod_base = OTHER; note = 2'-deoxy-2'-fluoroguanosine-3'-phosphate
  modified_base 6: mod_base = OTHER; note = 2'-O-methyladenosine-3'-phosphate
  modified_base 7: mod_base = OTHER; note = 2'-deoxy-2'-fluorocytidine-3'-phosphate
  modified_base 8: mod_base = OTHER; note = 2'-O-methyladenosine-3'-phosphate
  modified_base 9: mod_base = OTHER; note = 2'-deoxy-2'-fluorouridine-3'-phosphate
  modified_base 10: mod_base = OTHER; note = 2'-deoxy-2'-fluorouridine-3'-phosphate
  modified_base 11: mod_base = OTHER; note = 2'-deoxy-2'-fluorocytidine-3'-phosphate
  modified_base 12: mod_base = OTHER; note = 2'-O-methyladenosine-3'-phosphate
  modified_base 13: mod_base = OTHER; note = 2'-deoxy-2'-fluoroguanosine-3'-phosphate
  modified_base 14: mod_base = OTHER; note = 2'-O-methyladenosine-3'-phosphate
  modified_base 15: mod_base = OTHER; note = 2'-deoxy-2'-fluoroadenosine-3'-phosphate
  modified_base 16: mod_base = OTHER; note = 2'-O-methylcytidine-3'-phosphate
  modified_base 17: mod_base = OTHER; note = 2'-deoxy-2'-fluoroadenosine-3'-phosphate
  modified_base 18: mod_base = OTHER; note = 2'-O-methyladenosine-3'-phosphate
  modified_base 19: mod_base = OTHER; note = 2'-deoxy-2'-fluoroguanosine-3'-phosphate
  modified_base 20: mod_base = OTHER; note = 2'-O-methyladenosine-3'-phosphate
  modified_base 21: mod_base = OTHER; note = 2'-deoxy-2'-fluoroadenosine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
cctggacattcagaacaagaa

SEQ ID NO: 216 - RNA, 21 nt, synthetic construct
  source 1..21: mol_type = other RNA
  modified_base 1: mod_base = OTHER; note = 2'-deoxy-2'-fluorocytidine-3'-phosphorothioate
  modified_base 2: mod_base = OTHER; note = 2'-O-methylcytidine-3'-phosphorothioate
  modified_base 3: mod_base = OTHER; note = 2'-deoxy-2'-fluorouridine-3'-phosphate
  modified_base 4: mod_base = OTHER; note = 2'-O-methylguanosine-3'-phosphate
  modified_base 5: mod_base = OTHER; note = 2'-deoxy-2'-fluoroguanosine-3'-phosphate
  modified_base 6: mod_base = OTHER; note = 2'-O-methyladenosine-3'-phosphate
  modified_base 7: mod_base = OTHER; note = 2'-deoxy-2'-fluorocytidine-3'-phosphate
  modified_base 8: mod_base = OTHER; note = 2'-O-methyladenosine-3'-phosphate
  modified_base 9: mod_base = OTHER; note = 2'-deoxy-2'-fluorouridine-3'-phosphate
  modified_base 10: mod_base = OTHER; note = 2'-deoxy-2'-fluorouridine-3'-phosphate
  modified_base 11: mod_base = OTHER; note = 2'-deoxy-2'-fluorocytidine-3'-phosphate
  modified_base 12: mod_base = OTHER; note = 2'-O-methyladenosine-3'-phosphate
  modified_base 13: mod_base = OTHER; note = 2'-deoxy-2'-fluoroguanosine-3'-phosphate
  modified_base 14: mod_base = OTHER; note = 2'-O-methyladenosine-3'-phosphate
  modified_base 15: mod_base = OTHER; note = 2'-deoxy-2'-fluoroadenosine-3'-phosphate
  modified_base 16: mod_base = OTHER; note = 2'-O-methylcytidine-3'-phosphate
  modified_base 17: mod_base = OTHER; note = 2'-deoxy-2'-fluoroadenosine-3'-phosphate
  modified_base 18: mod_base = OTHER; note = 2'-O-methyladenosine-3'-phosphate
  modified_base 19: mod_base = OTHER; note = 2'-deoxy-2'-fluoroguanosine-3'-phosphate
  modified_base 20: mod_base = OTHER; note = 2'-O-methyladenosine-3'-phosphate
  modified_base 21: mod_base = OTHER; note = 2'-deoxy-2'-fluoroadenosine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
cctggacattcagaacaagaa

SEQ ID NO: 217 - RNA, 21 nt, synthetic construct
  source 1..21: mol_type = other RNA
  modified_base 1: mod_base = OTHER; note = 2'-deoxy-2'-fluorouridine-3'-phosphorothioate
  modified_base 2: mod_base = OTHER; note = 2'-O-methylguanosine-3'-phosphorothioate
  modified_base 3: mod_base = OTHER; note = 2'-deoxy-2'-fluorouridine-3'-phosphate
  modified_base 4: mod_base = OTHER; note = 2'-O-methylguanosine-3'-phosphate
  modified_base 5: mod_base = OTHER; note = 2'-deoxy-2'-fluoroadenosine-3'-phosphate
  modified_base 6: mod_base = OTHER; note = 2'-O-methylcytidine-3'-phosphate
  modified_base 7: mod_base = OTHER; note = 2'-deoxy-2'-fluoroadenosine-3'-phosphate
  modified_base 8: mod_base = OTHER; note = 2'-O-methyladenosine-3'-phosphate
  modified_base 9: mod_base = OTHER; note = 2'-deoxy-2'-fluoroadenosine-3'-phosphate
  modified_base 10: mod_base = OTHER; note = 2'-deoxy-2'-fluorouridine-3'-phosphate
  modified_base 11: mod_base = OTHER; note = 2'-deoxy-2'-fluoroadenosine-3'-phosphate
  modified_base 12: mod_base = OTHER; note = 2'-O-methyluridine-3'-phosphate
  modified_base 13: mod_base = OTHER; note = 2'-deoxy-2'-fluoroguanosine-3'-phosphate
  modified_base 14: mod_base = OTHER; note = 2'-O-methylguanosine-3'-phosphate
  modified_base 15: mod_base = OTHER; note = 2'-deoxy-2'-fluoroguanosine-3'-phosphate
  modified_base 16: mod_base = OTHER; note = 2'-O-methylcytidine-3'-phosphate
  modified_base 17: mod_base = OTHER; note = 2'-deoxy-2'-fluoroadenosine-3'-phosphate
  modified_base 18: mod_base = OTHER; note = 2'-O-methyluridine-3'-phosphate
  modified_base 19: mod_base = OTHER; note = 2'-deoxy-2'-fluorocytidine-3'-phosphate
  modified_base 20: mod_base = OTHER; note = 2'-O-methyladenosine-3'-phosphate
  modified_base 21: mod_base = OTHER; note = 2'-deoxy-2'-fluoroadenosine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
tgtgacaaatatgggcatcaa

SEQ ID NO: 218 - RNA, 21 nt, synthetic construct
  source 1..21: mol_type = other RNA
  modified_base 1: mod_base = OTHER; note = 2'-deoxy-2'-fluorouridine-3'-phosphorothioate
  modified_base 2: mod_base = OTHER; note = 2'-O-methylguanosine-3'-phosphorothioate
  modified_base 3: mod_base = OTHER; note = 2'-deoxy-2'-fluorouridine-3'-phosphate
  modified_base 4: mod_base = OTHER; note = 2'-O-methylguanosine-3'-phosphate
  modified_base 5: mod_base = OTHER; note = 2'-deoxy-2'-fluoroadenosine-3'-phosphate
  modified_base 6: mod_base = OTHER; note = 2'-O-methylcytidine-3'-phosphate
  modified_base 7: mod_base = OTHER; note = 2'-deoxy-2'-fluoroadenosine-3'-phosphate
  modified_base 8: mod_base = OTHER; note = 2'-O-methyladenosine-3'-phosphate
  modified_base 9: mod_base = OTHER; note = 2'-deoxy-2'-fluoroadenosine-3'-phosphate
  modified_base 10: mod_base = OTHER; note = 2'-deoxy-2'-fluorouridine-3'-phosphate
  modified_base 11: mod_base = OTHER; note = 2'-deoxy-2'-fluoroadenosine-3'-phosphate
  modified_base 12: mod_base = OTHER; note = 2'-O-methyluridine-3'-phosphate
  modified_base 13: mod_base = OTHER; note = 2'-deoxy-2'-fluoroguanosine-3'-phosphate
  modified_base 14: mod_base = OTHER; note = 2'-O-methylguanosine-3'-phosphate
  modified_base 15: mod_base = OTHER; note = 2'-deoxy-2'-fluoroguanosine-3'-phosphate
  modified_base 16: mod_base = OTHER; note = 2'-O-methylcytidine-3'-phosphate
  modified_base 17: mod_base = OTHER; note = 2'-deoxy-2'-fluoroadenosine-3'-phosphate
  modified_base 18: mod_base = OTHER; note = 2'-O-methyluridine-3'-phosphate
  modified_base 19: mod_base = OTHER; note = 2'-deoxy-2'-fluorocytidine-3'-phosphate
  modified_base 20: mod_base = OTHER; note = 2'-O-methyladenosine-3'-phosphate
  modified_base 21: mod_base = OTHER; note = 2'-deoxy-2'-fluoroadenosine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
tgtgacaaatatgggcatcaa

SEQ ID NO: 219 - RNA, 21 nt, synthetic construct
  source 1..21: mol_type = other RNA
  modified_base 1: mod_base = OTHER; note = 2'-deoxy-2'-fluorocytidine-3'-phosphorothioate
  modified_base 2: mod_base = OTHER; note = 2'-O-methylcytidine-3'-phosphorothioate
  modified_base 3: mod_base = OTHER; note = 2'-deoxy-2'-fluorouridine-3'-phosphate
  modified_base 4: mod_base = OTHER; note = 2'-O-methylguanosine-3'-phosphate
  modified_base 5: mod_base = OTHER; note = 2'-deoxy-2'-fluoroguanosine-3'-phosphate
  modified_base 6: mod_base = OTHER; note = 2'-O-methyladenosine-3'-phosphate
  modified_base 7: mod_base = OTHER; note = 2'-deoxy-2'-fluorocytidine-3'-phosphate
  modified_base 8: mod_base = OTHER; note = 2'-O-methyladenosine-3'-phosphate
  modified_base 9: mod_base = OTHER; note = 2'-deoxy-2'-fluorouridine-3'-phosphate
  modified_base 10: mod_base = OTHER; note = 2'-deoxy-2'-fluorouridine-3'-phosphate
  modified_base 11: mod_base = OTHER; note = 2'-deoxy-2'-fluorocytidine-3'-phosphate
  modified_base 12: mod_base = OTHER; note = 2'-O-methyladenosine-3'-phosphate
  modified_base 13: mod_base = OTHER; note = 2'-deoxy-2'-fluoroguanosine-3'-phosphate
  modified_base 14: mod_base = OTHER; note = 2'-O-methyladenosine-3'-phosphate
  modified_base 15: mod_base = OTHER; note = 2'-deoxy-2'-fluoroadenosine-3'-phosphate
  modified_base 16: mod_base = OTHER; note = 2'-O-methylcytidine-3'-phosphate
  modified_base 17: mod_base = OTHER; note = 2'-deoxy-2'-fluoroadenosine-3'-phosphate
  modified_base 18: mod_base = OTHER; note = 2'-O-methyladenosine-3'-phosphate
  modified_base 19: mod_base = OTHER; note = 2'-deoxy-2'-fluoroguanosine-3'-phosphate
  modified_base 20: mod_base = OTHER; note = 2'-O-methyladenosine-3'-phosphate
  modified_base 21: mod_base = OTHER; note = 2'-deoxy-2'-fluoroadenosine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
cctggacattcagaacaagaa

SEQ ID NO: 220 - RNA, 21 nt, synthetic construct
  source 1..21: mol_type = other RNA
  modified_base 1: mod_base = OTHER; note = 2'-deoxy-2'-fluorouridine-3'-phosphorothioate
  modified_base 2: mod_base = OTHER; note = 2'-O-methylguanosine-3'-phosphorothioate
  modified_base 3: mod_base = OTHER; note = 2'-deoxy-2'-fluorouridine-3'-phosphate
  modified_base 4: mod_base = OTHER; note = 2'-O-methylguanosine-3'-phosphate
  modified_base 5: mod_base = OTHER; note = 2'-deoxy-2'-fluoroadenosine-3'-phosphate
  modified_base 6: mod_base = OTHER; note = 2'-O-methylcytidine-3'-phosphate
  modified_base 7: mod_base = OTHER; note = 2'-deoxy-2'-fluoroadenosine-3'-phosphate
  modified_base 8: mod_base = OTHER; note = 2'-O-methyladenosine-3'-phosphate
  modified_base 9: mod_base = OTHER; note = 2'-deoxy-2'-fluoroadenosine-3'-phosphate
  modified_base 10: mod_base = OTHER; note = 2'-deoxy-2'-fluorouridine-3'-phosphate
  modified_base 11: mod_base = OTHER; note = 2'-deoxy-2'-fluoroadenosine-3'-phosphate
  modified_base 12: mod_base = OTHER; note = 2'-O-methyluridine-3'-phosphate
  modified_base 13: mod_base = OTHER; note = 2'-deoxy-2'-fluoroguanosine-3'-phosphate
  modified_base 14: mod_base = OTHER; note = 2'-O-methylguanosine-3'-phosphate
  modified_base 15: mod_base = OTHER; note = 2'-deoxy-2'-fluoroguanosine-3'-phosphate
  modified_base 16: mod_base = OTHER; note = 2'-O-methylcytidine-3'-phosphate
  modified_base 17: mod_base = OTHER; note = 2'-deoxy-2'-fluoroadenosine-3'-phosphate
  modified_base 18: mod_base = OTHER; note = 2'-O-methyluridine-3'-phosphate
  modified_base 19: mod_base = OTHER; note = 2'-deoxy-2'-fluorocytidine-3'-phosphate
  modified_base 20: mod_base = OTHER; note = 2'-O-methyladenosine-3'-phosphate
  modified_base 21: mod_base = OTHER; note = 2'-deoxy-2'-fluoroadenosine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
tgtgacaaatatgggcatcaa

SEQ ID NO: 221 - DNA, 21 bp, synthetic construct
  source 1..21: mol_type = other DNA
  modified_base 1: mod_base = OTHER; note = 2'-deoxy-2'-fluoroadenosine-3'-phosphate
  modified_base 2: mod_base = OTHER; note = 2'-O-methyladenosine-3'-phosphate
  modified_base 3: mod_base = OTHER; note = 2'-deoxy-2'-fluoroguanosine-3'-phosphate
  modified_base 4: mod_base = OTHER; note = 2'-O-methyluridine-3'-phosphate
  modified_base 5: mod_base = OTHER; note = 2'-deoxy-2'-fluoroadenosine-3'-phosphate
  modified_base 6: mod_base = OTHER; note = 2'-O-methyladenosine-3'-phosphate
  modified_base 7: mod_base = OTHER; note = 2'-deoxy-2'-fluoroguanosine-3'-phosphate
  modified_base 8: mod_base = OTHER; note = 2'-O-methylguanosine-3'-phosphate
  modified_base 9: mod_base = OTHER; note = 2'-deoxy-2'-fluoroadenosine-3'-phosphate
  modified_base 10: mod_base = OTHER; note = 2'-O-methylcytidine-3'-phosphate
  modified_base 11: mod_base = OTHER; note = 2'-deoxy-2'-fluorocytidine-3'-phosphate
  modified_base 12: mod_base = OTHER; note = 2'-O-methyladenosine-3'-phosphate
  modified_base 13: mod_base = OTHER; note = 2'-deoxy-2'-fluoroguanosine-3'-phosphate
  modified_base 14: mod_base = OTHER; note = 2'-O-methyladenosine-3'-phosphate
  modified_base 15: mod_base = OTHER; note = 2'-deoxy-2'-fluoroguanosine-3'-phosphate
  modified_base 16: mod_base = OTHER; note = 2'-O-methyladenosine-3'-phosphate
  modified_base 17: mod_base = OTHER; note = 2'-deoxy-2'-fluorocytidine-3'-phosphate
  modified_base 18: mod_base = OTHER; note = 2'-O-methyladenosine-3'-phosphate
  modified_base 19: mod_base = OTHER; note = 2'-deoxy-2'-fluoroadenosine-3'-phosphate
  modified_base 20: mod_base = OTHER; note = 2'-deoxythymidine-3'-phosphorothioate
  misc_feature 1..19: note = RNA
  misc_feature 20..21: note = DNA
aagtaaggaccagagacaatt

SEQ ID NO: 222 - DNA, 21 bp, synthetic construct
  source 1..21: mol_type = other DNA
  modified_base 1: mod_base = OTHER; note = 2'-deoxy-2'-fluoroadenosine-3'-phosphate
  modified_base 2: mod_base = OTHER; note = 2'-O-methyladenosine-3'-phosphate
  modified_base 3: mod_base = OTHER; note = 2'-deoxy-2'-fluoroguanosine-3'-phosphate
  modified_base 4: mod_base = OTHER; note = 2'-O-methyluridine-3'-phosphate
  modified_base 5: mod_base = OTHER; note = 2'-deoxy-2'-fluoroadenosine-3'-phosphate
  modified_base 6: mod_base = OTHER; note = 2'-O-methyladenosine-3'-phosphate
  modified_base 7: mod_base = OTHER; note = 2'-deoxy-2'-fluoroguanosine-3'-phosphate
  modified_base 8: mod_base = OTHER; note = 2'-O-methylguanosine-3'-phosphate
  modified_base 9: mod_base = OTHER; note = 2'-deoxy-2'-fluoroadenosine-3'-phosphate
  modified_base 10: mod_base = OTHER; note = 2'-O-methylcytidine-3'-phosphate
  modified_base 11: mod_base = OTHER; note = 2'-deoxy-2'-fluorocytidine-3'-phosphate
  modified_base 12: mod_base = OTHER; note = 2'-O-methyladenosine-3'-phosphate
  modified_base 13: mod_base = OTHER; note = 2'-deoxy-2'-fluoroguanosine-3'-phosphate
  modified_base 14: mod_base = OTHER; note = 2'-O-methyladenosine-3'-phosphate
  modified_base 15: mod_base = OTHER; note = 2'-deoxy-2'-fluoroguanosine-3'-phosphate
  modified_base 16: mod_base = OTHER; note = 2'-O-methyladenosine-3'-phosphate
  modified_base 17: mod_base = OTHER; note = 2'-deoxy-2'-fluorocytidine-3'-phosphate
  modified_base 18: mod_base = OTHER; note = 2'-O-methyladenosine-3'-phosphate
  modified_base 19: mod_base = OTHER; note = 2'-deoxy-2'-fluoroadenosine-3'-phosphate
  modified_base 20: mod_base = OTHER; note = 2'-deoxythymidine-3'-phosphorothioate
  misc_feature 1..19: note = RNA
  misc_feature 20..21: note = DNA
aagtaaggaccagagacaatt

SEQ ID NO: 223 - DNA, 21 bp, synthetic construct
  source 1..21: mol_type = other DNA
  modified_base 1: mod_base = OTHER; note = 2'-deoxy-2'-fluoroadenosine-3'-phosphate
  modified_base 2: mod_base = OTHER; note = 2'-O-methyladenosine-3'-phosphate
  modified_base 3: mod_base = OTHER; note = 2'-deoxy-2'-fluoroguanosine-3'-phosphate
  modified_base 4: mod_base = OTHER; note = 2'-O-methyluridine-3'-phosphate
  modified_base 5: mod_base = OTHER; note = 2'-deoxy-2'-fluoroadenosine-3'-phosphate
  modified_base 6: mod_base = OTHER; note = 2'-O-methyladenosine-3'-phosphate
  modified_base 7: mod_base = OTHER; note = 2'-deoxy-2'-fluoroguanosine-3'-phosphate
  modified_base 8: mod_base = OTHER; note = 2'-O-methylguanosine-3'-phosphate
  modified_base 9: mod_base = OTHER; note = 2'-deoxy-2'-fluoroadenosine-3'-phosphate
  modified_base 10: mod_base = OTHER; note = 2'-O-methylcytidine-3'-phosphate
  modified_base 11: mod_base = OTHER; note = 2'-deoxy-2'-fluorocytidine-3'-phosphate
  modified_base 12: mod_base = OTHER; note = 2'-O-methyladenosine-3'-phosphate
  modified_base 13: mod_base = OTHER; note = 2'-deoxy-2'-fluoroguanosine-3'-phosphate
  modified_base 14: mod_base = OTHER; note = 2'-O-methyladenosine-3'-phosphate
  modified_base 15: mod_base = OTHER; note = 2'-deoxy-2'-fluoroguanosine-3'-phosphate
  modified_base 16: mod_base = OTHER; note = 2'-O-methyladenosine-3'-phosphate
  modified_base 17: mod_base = OTHER; note = 2'-deoxy-2'-fluorocytidine-3'-phosphate
  modified_base 18: mod_base = OTHER; note = 2'-O-methyladenosine-3'-phosphate
  modified_base 19: mod_base = OTHER; note = 2'-deoxy-2'-fluoroadenosine-3'-phosphate
  modified_base 20: mod_base = OTHER; note = 2'-deoxythymidine-3'-phosphorothioate
  misc_feature 1..19: note = RNA
  misc_feature 20..21: note = DNA
aagtaaggaccagagacaatt

SEQ ID NO: 224 - RNA, 23 nt, synthetic construct
  source 1..23: mol_type = other RNA
  modified_base 1: mod_base = OTHER; note = 2'-O-methyluridine-3'-phosphorothioate
  modified_base 2: mod_base = OTHER; note = 2'-deoxy-2'-fluorouridine-3'-phosphorothioate
  modified_base 3: mod_base = OTHER; note = 2'-O-methylcytidine-3'-phosphate
  modified_base 4: mod_base = OTHER; note = 2'-deoxy-2'-fluorouridine-3'-phosphate
  modified_base 5: mod_base = OTHER; note = 2'-O-methyluridine-3'-phosphate
  modified_base 6: mod_base = OTHER; note = 2'-deoxy-2'-fluoroguanosine-3'-phosphate
  modified_base 7: mod_base = OTHER; note = 2'-O-methyluridine-3'-phosphate
  modified_base 8: mod_base = OTHER; note = 2'-deoxy-2'-fluorouridine-3'-phosphate
  modified_base 9: mod_base = OTHER; note = 2'-O-methylcytidine-3'-phosphate
  modified_base 10: mod_base = OTHER; note = 2'-deoxy-2'-fluorouridine-3'-phosphate
  modified_base 11: mod_base = OTHER; note = 2'-O-methylguanosine-3'-phosphate
  modified_base 12: mod_base = OTHER; note = 2'-O-methyladenosine-3'-phosphate
  modified_base 13: mod_base = OTHER; note = 2'-O-methyladenosine-3'-phosphate
  modified_base 14: mod_base = OTHER; note = 2'-deoxy-2'-fluorouridine-3'-phosphate
  modified_base 15: mod_base = OTHER; note = 2'-O-methylguanosine-3'-phosphate
  modified_base 16: mod_base = OTHER; note = 2'-deoxy-2'-fluorouridine-3'-phosphate
  modified_base 17: mod_base = OTHER; note = 2'-O-methylcytidine-3'-phosphate
  modified_base 18: mod_base = OTHER; note = 2'-deoxy-2'-fluorocytidine-3'-phosphate
  modified_base 19: mod_base = OTHER; note = 2'-O-methyladenosine-3'-phosphate
  modified_base 20: mod_base = OTHER; note = 2'-deoxy-2'-fluoroguanosine-3'-phosphate
  modified_base 21: mod_base = OTHER; note = 2'-O-methylguanosine-3'-phosphorothioate
  modified_base 22: mod_base = OTHER; note = 2'-O-methylguanosine-3'-phosphorothioate
  modified_base 23: mod_base = OTHER; note = 2'-O-methyluridine
ttcttgttctgaatgtccagggt

SEQ ID NO: 225 - RNA, 23 nt, synthetic construct
  source 1..23: mol_type = other RNA
  modified_base 1: mod_base = OTHER; note = 2'-O-methyluridine-3'-phosphorothioate 5'phosphate
  modified_base 2: mod_base = OTHER; note = 2'-deoxy-2'-fluorouridine-3'-phosphorothioate
  modified_base 3: mod_base = OTHER; note = 2'-O-methylcytidine-3'-phosphate
  modified_base 4: mod_base = OTHER; note = 2'-deoxy-2'-fluorouridine-3'-phosphate
  modified_base 5: mod_base = OTHER; note = 2'-O-methyluridine-3'-phosphate
  modified_base 6: mod_base = OTHER; note = 2'-deoxy-2'-fluoroguanosine-3'-phosphate
  modified_base 7: mod_base = OTHER; note = 2'-O-methyluridine-3'-phosphate
  modified_base 8: mod_base = OTHER; note = 2'-deoxy-2'-fluorouridine-3'-phosphate
  modified_base 9: mod_base = OTHER; note = 2'-O-methylcytidine-3'-phosphate
  modified_base 10: mod_base = OTHER; note = 2'-deoxy-2'-fluorouridine-3'-phosphate
  modified_base 11: mod_base = OTHER; note = 2'-O-methylguanosine-3'-phosphate
  modified_base 12: mod_base = OTHER; note = 2'-O-methyladenosine-3'-phosphate
  modified_base 13: mod_base = OTHER; note = 2'-O-methyladenosine-3'-phosphate
  modified_base 14: mod_base = OTHER; note = 2'-deoxy-2'-fluorouridine-3'-phosphate
  modified_base 15: mod_base = OTHER; note = 2'-O-methylguanosine-3'-phosphate
  modified_base 16: mod_base = OTHER; note = 2'-deoxy-2'-fluorouridine-3'-phosphate
  modified_base 17: mod_base = OTHER; note = 2'-O-methylcytidine-3'-phosphate
  modified_base 18: mod_base = OTHER; note = 2'-deoxy-2'-fluorocytidine-3'-phosphate
  modified_base 19: mod_base = OTHER; note = 2'-O-methyladenosine-3'-phosphate
  modified_base 20: mod_base = OTHER; note = 2'-deoxy-2'-fluoroguanosine-3'-phosphate
  modified_base 21: mod_base = OTHER; note = 2'-O-methylguanosine-3'-phosphorothioate
  modified_base 22: mod_base = OTHER; note = 2'-O-methylguanosine-3'-phosphorothioate
  modified_base 23: mod_base = OTHER; note = 2'-O-methyluridine
ttcttgttctgaatgtccagggt

SEQ ID NO: 226 - RNA, 23 nt, synthetic construct
  source 1..23: mol_type = other RNA
  modified_base 1: mod_base = OTHER; note = 2'-O-methyluridine-3'-phosphorothioate
  modified_base 2: mod_base = OTHER; note = 2'-deoxy-2'-fluorouridine-3'-phosphorothioate
  modified_base 3: mod_base = OTHER; note = 2'-O-methylguanosine-3'-phosphate
  modified_base 4: mod_base = OTHER; note = 2'-deoxy-2'-fluoroadenosine-3'-phosphate
  modified_base 5: mod_base = OTHER; note = 2'-O-methyluridine-3'-phosphate
  modified_base 6: mod_base = OTHER; note = 2'-deoxy-2'-fluoroguanosine-3'-phosphate
  modified_base 7: mod_base = OTHER; note = 2'-O-methylcytidine-3'-phosphate
  modified_base 8: mod_base = OTHER; note = 2'-deoxy-2'-fluorocytidine-3'-phosphate
  modified_base 9: mod_base = OTHER; note = 2'-O-methylcytidine-3'-phosphate
  modified_base 10: mod_base = OTHER; note = 2'-deoxy-2'-fluoroadenosine-3'-phosphate
  modified_base 11: mod_base = OTHER; note = 2'-O-methyluridine-3'-phosphate
  modified_base 12: mod_base = OTHER; note = 2'-O-methyladenosine-3'-phosphate
  modified_base 13: mod_base = OTHER; note = 2'-O-methyluridine-3'-phosphate
  modified_base 14: mod_base = OTHER; note = 2'-deoxy-2'-fluorouridine-3'-phosphate
  modified_base 15: mod_base = OTHER; note = 2'-O-methyluridine-3'-phosphate
  modified_base 16: mod_base = OTHER; note = 2'-deoxy-2'-fluoroguanosine-3'-phosphate
  modified_base 17: mod_base = OTHER; note = 2'-O-methyluridine-3'-phosphate
  modified_base 18: mod_base = OTHER; note = 2'-deoxy-2'-fluorocytidine-3'-phosphate
  modified_base 19: mod_base = OTHER; note = 2'-O-methyladenosine-3'-phosphate
  modified_base 20: mod_base = OTHER; note = 2'-deoxy-2'-fluorocytidine-3'-phosphate
  modified_base 21: mod_base = OTHER; note = 2'-O-methyladenosine-3'-phosphorothioate
  modified_base 22: mod_base = OTHER; note = 2'-O-methyladenosine-3'-phosphorothioate
  modified_base 23: mod_base = OTHER; note = 2'-O-methyladenosine
ttgatgcccatatttgtcacaaa

SEQ ID NO: 227 - RNA, 23 nt, synthetic construct
  source 1..23: mol_type = other RNA
  modified_base 1: mod_base = OTHER; note = 2'-O-methyluridine-3'-phosphorothioate 5'phosphate
  modified_base 2: mod_base = OTHER; note = 2'-deoxy-2'-fluorouridine-3'-phosphorothioate
  modified_base 3: mod_base = OTHER; note = 2'-O-methylguanosine-3'-phosphate
  modified_base 4: mod_base = OTHER; note = 2'-deoxy-2'-fluoroadenosine-3'-phosphate
  modified_base 5: mod_base = OTHER; note = 2'-O-methyluridine-3'-phosphate
  modified_base 6: mod_base = OTHER; note = 2'-deoxy-2'-fluoroguanosine-3'-phosphate
  modified_base 7: mod_base = OTHER; note = 2'-O-methylcytidine-3'-phosphate
  modified_base 8: mod_base = OTHER; note = 2'-deoxy-2'-fluorocytidine-3'-phosphate
  modified_base 9: mod_base = OTHER; note = 2'-O-methylcytidine-3'-phosphate
  modified_base 10: mod_base = OTHER; note = 2'-deoxy-2'-fluoroadenosine-3'-phosphate
  modified_base 11: mod_base = OTHER; note = 2'-O-methyluridine-3'-phosphate
  modified_base 12: mod_base = OTHER; note = 2'-O-methyladenosine-3'-phosphate
  modified_base 13: mod_base = OTHER; note = 2'-O-methyluridine-3'-phosphate
  modified_base 14: mod_base = OTHER; note = 2'-deoxy-2'-fluorouridine-3'-phosphate
  modified_base 15: mod_base = OTHER; note = 2'-O-methyluridine-3'-phosphate
  modified_base 16: mod_base = OTHER; note = 2'-deoxy-2'-fluoroguanosine-3'-phosphate
  modified_base 17: mod_base = OTHER; note = 2'-O-methyluridine-3'-phosphate
  modified_base 18: mod_base = OTHER; note = 2'-deoxy-2'-fluorocytidine-3'-phosphate
  modified_base 19: mod_base = OTHER; note = 2'-O-methyladenosine-3'-phosphate
  modified_base 20: mod_base = OTHER; note = 2'-deoxy-2'-fluorocytidine-3'-phosphate
  modified_base 21: mod_base = OTHER; note = 2'-O-methyladenosine-3'-phosphorothioate
  modified_base 22: mod_base = OTHER; note = 2'-O-methyladenosine-3'-phosphorothioate
  modified_base 23: mod_base = OTHER; note = 2'-O-methyladenosine
ttgatgcccatatttgtcacaaa

SEQ ID NO: 228 - RNA, 23 nt, synthetic construct
  source 1..23: mol_type = other RNA
  modified_base 1: mod_base = OTHER; note = 2'-O-methyl-5'-malonic acid-uridine-3'-phosphorothioate
  modified_base 2: mod_base = OTHER; note = 2'-deoxy-2'-fluorouridine-3'-phosphorothioate
  modified_base 3: mod_base = OTHER; note = 2'-O-methylcytidine-3'-phosphate
  modified_base 4: mod_base = OTHER; note = 2'-deoxy-2'-fluorouridine-3'-phosphate
  modified_base 5: mod_base = OTHER; note = 2'-O-methyluridine-3'-phosphate
  modified_base 6: mod_base = OTHER; note = 2'-deoxy-2'-fluoroguanosine-3'-phosphate
  modified_base 7: mod_base = OTHER; note = 2'-O-methyluridine-3'-phosphate
  modified_base 8: mod_base = OTHER; note = 2'-deoxy-2'-fluorouridine-3'-phosphate
  modified_base 9: mod_base = OTHER; note = 2'-O-methylcytidine-3'-phosphate
  modified_base 10: mod_base = OTHER; note = 2'-deoxy-2'-fluorouridine-3'-phosphate
  modified_base 11: mod_base = OTHER; note = 2'-O-methylguanosine-3'-phosphate
  modified_base 12: mod_base = OTHER; note = 2'-O-methyladenosine-3'-phosphate
  modified_base 13: mod_base = OTHER; note = 2'-O-methyladenosine-3'-phosphate
  modified_base 14: mod_base = OTHER; note = 2'-deoxy-2'-fluorouridine-3'-phosphate
  modified_base 15: mod_base = OTHER; note = 2'-O-methylguanosine-3'-phosphate
  modified_base 16: mod_base = OTHER; note = 2'-deoxy-2'-fluorouridine-3'-phosphate
  modified_base 17: mod_base = OTHER; note = 2'-O-methylcytidine-3'-phosphate
  modified_base 18: mod_base = OTHER; note = 2'-deoxy-2'-fluorocytidine-3'-phosphate
  modified_base 19: mod_base = OTHER; note = 2'-O-methyladenosine-3'-phosphate
  modified_base 20: mod_base = OTHER; note = 2'-deoxy-2'-fluoroguanosine-3'-phosphate
  modified_base 21: mod_base = OTHER; note = 2'-O-methylguanosine-3'-phosphorothioate
  modified_base 22: mod_base = OTHER; note = 2'-O-methylguanosine-3'-phosphorothioate
  modified_base 23: mod_base = OTHER; note = 2'-O-methyluridine
ttcttgttctgaatgtccagggt

SEQ ID NO: 229 - RNA, 23 nt, synthetic construct
  source 1..23: mol_type = other RNA
  modified_base 1: mod_base = OTHER; note = 2'-O-methyl-5'-malonic acid-uridine-3'-phosphorothioate
  modified_base 2: mod_base = OTHER; note = 2'-deoxy-2'-fluorouridine-3'-phosphorothioate
  modified_base 3: mod_base = OTHER; note = 2'-O-methylguanosine-3'-phosphate
  modified_base 4: mod_base = OTHER; note = 2'-deoxy-2'-fluoroadenosine-3'-phosphate
  modified_base 5: mod_base = OTHER; note = 2'-O-methyluridine-3'-phosphate
  modified_base 6: mod_base = OTHER; note = 2'-deoxy-2'-fluoroguanosine-3'-phosphate
  modified_base 7: mod_base = OTHER; note = 2'-O-methylcytidine-3'-phosphate
  modified_base 8: mod_base = OTHER; note = 2'-deoxy-2'-fluorocytidine-3'-phosphate
  modified_base 9: mod_base = OTHER; note = 2'-O-methylcytidine-3'-phosphate
  modified_base 10: mod_base = OTHER; note = 2'-deoxy-2'-fluoroadenosine-3'-phosphate
  modified_base 11: mod_base = OTHER; note = 2'-O-methyluridine-3'-phosphate
  modified_base 12: mod_base = OTHER; note = 2'-O-methyladenosine-3'-phosphate
  modified_base 13: mod_base = OTHER; note = 2'-O-methyluridine-3'-phosphate
  modified_base 14: mod_base = OTHER; note = 2'-deoxy-2'-fluorouridine-3'-phosphate
  modified_base 15: mod_base = OTHER; note = 2'-O-methyluridine-3'-phosphate
  modified_base 16: mod_base = OTHER; note = 2'-deoxy-2'-fluoroguanosine-3'-phosphate
  modified_base 17: mod_base = OTHER; note = 2'-O-methyluridine-3'-phosphate
  modified_base 18: mod_base = OTHER; note = 2'-deoxy-2'-fluorocytidine-3'-phosphate
  modified_base 19: mod_base = OTHER; note = 2'-O-methyladenosine-3'-phosphate
  modified_base 20: mod_base = OTHER; note = 2'-deoxy-2'-fluorocytidine-3'-phosphate
  modified_base 21: mod_base = OTHER; note = 2'-O-methyladenosine-3'-phosphorothioate
  modified_base 22: mod_base = OTHER; note = 2'-O-methyladenosine-3'-phosphorothioate
  modified_base 23: mod_base = OTHER; note = 2'-O-methyladenosine
ttgatgcccatatttgtcacaaa

SEQ ID NO: 230 - DNA, 21 bp, synthetic construct
  source 1..21: mol_type = other DNA
  modified_base 1: mod_base = OTHER; note = 2'-O-methyluridine-3'-phosphate
  modified_base 2: mod_base = OTHER; note = 2'-deoxy-2'-fluorouridine-3'-phosphate
  modified_base 3: mod_base = OTHER; note = 2'-O-methylguanosine-3'-phosphate
  modified_base 4: mod_base = OTHER; note = 2'-deoxy-2'-fluorouridine-3'-phosphate
  modified_base 5: mod_base = OTHER; note = 2'-O-methylcytidine-3'-phosphate
  modified_base 6: mod_base = OTHER; note = 2'-deoxy-2'-fluorouridine-3'-phosphate
  modified_base 7: mod_base = OTHER; note = 2'-O-methylcytidine-3'-phosphate
  modified_base 8: mod_base = OTHER; note = 2'-deoxy-2'-fluorouridine-3'-phosphate
  modified_base 9: mod_base = OTHER; note = 2'-O-methylguanosine-3'-phosphate
  modified_base 10: mod_base = OTHER; note = 2'-deoxy-2'-fluoroguanosine-3'-phosphate
  modified_base 11: mod_base = OTHER; note = 2'-O-methyluridine-3'-phosphate
  modified_base 12: mod_base = OTHER; note = 2'-deoxy-2'-fluorocytidine-3'-phosphate
  modified_base 13: mod_base = OTHER; note = 2'-O-methylcytidine-3'-phosphate
  modified_base 14: mod_base = OTHER; note = 2'-deoxy-2'-fluorouridine-3'-phosphate
  modified_base 15: mod_base = OTHER; note = 2'-O-methyluridine-3'-phosphate
  modified_base 16: mod_base = OTHER; note = 2'-deoxy-2'-fluoroadenosine-3'-phosphate
  modified_base 17: mod_base = OTHER; note = 2'-O-methylcytidine-3'-phosphate
  modified_base 18: mod_base = OTHER; note = 2'-deoxy-2'-fluorouridine-3'-phosphate
  modified_base 19: mod_base = OTHER; note = 2'-O-methyluridine-3'-phosphate
  modified_base 20: mod_base = OTHER; note = 2'-deoxythymidine-3'-phosphorothioate
  misc_feature 1..19: note = RNA
  misc_feature 20..21: note = DNA
ttgtctctggtccttactttt

SEQ ID NO: 231 - DNA, 21 bp, synthetic construct
  source 1..21: mol_type = other DNA
  modified_base 1: mod_base = OTHER; note = 2'-O-methyluridine-3'-phosphate 5'phosphate
  modified_base 2: mod_base = OTHER; note = 2'-deoxy-2'-fluorouridine-3'-phosphate
  modified_base 3: mod_base = OTHER; note = 2'-O-methylguanosine-3'-phosphate
  modified_base 4: mod_base = OTHER; note = 2'-deoxy-2'-fluorouridine-3'-phosphate
  modified_base 5: mod_base = OTHER; note = 2'-O-methylcytidine-3'-phosphate
  modified_base 6: mod_base = OTHER; note = 2'-deoxy-2'-fluorouridine-3'-phosphate
  modified_base 7: mod_base = OTHER; note = 2'-O-methylcytidine-3'-phosphate
  modified_base 8: mod_base = OTHER; note = 2'-deoxy-2'-fluorouridine-3'-phosphate
  modified_base 9: mod_base = OTHER; note = 2'-O-methylguanosine-3'-phosphate
  modified_base 10: mod_base = OTHER; note = 2'-deoxy-2'-fluoroguanosine-3'-phosphate
  modified_base 11: mod_base = OTHER; note = 2'-O-methyluridine-3'-phosphate
  modified_base 12: mod_base = OTHER; note = 2'-deoxy-2'-fluorocytidine-3'-phosphate
  modified_base 13: mod_base = OTHER; note = 2'-O-methylcytidine-3'-phosphate
  modified_base 14: mod_base = OTHER; note = 2'-deoxy-2'-fluorouridine-3'-phosphate
  modified_base 15: mod_base = OTHER; note = 2'-O-methyluridine-3'-phosphate
  modified_base 16: mod_base = OTHER; note = 2'-deoxy-2'-fluoroadenosine-3'-phosphate
  modified_base 17: mod_base = OTHER; note = 2'-O-methylcytidine-3'-phosphate
  modified_base 18: mod_base = OTHER; note = 2'-deoxy-2'-fluorouridine-3'-phosphate
  modified_base 19: mod_base = OTHER; note = 2'-O-methyluridine-3'-phosphate
  modified_base 20: mod_base = OTHER; note = 2'-deoxythymidine-3'-phosphorothioate
  misc_feature 1..19: note = RNA
  misc_feature 20..21: note = DNA
ttgtctctggtccttactttt

SEQ ID NO: 232 - DNA, 21 bp, synthetic construct
  source 1..21: mol_type = other DNA
  modified_base 1: mod_base = OTHER; note = 2'-O-methyl-5'-malonic acid-uridine-3'-phosphate
  modified_base 2: mod_base = OTHER; note = 2'-deoxy-2'-fluorouridine-3'-phosphate
  modified_base 3: mod_base = OTHER; note = 2'-O-methylguanosine-3'-phosphate
  modified_base 4: mod_base = OTHER; note = 2'-deoxy-2'-fluorouridine-3'-phosphate
  modified_base 5: mod_base = OTHER; note = 2'-O-methylcytidine-3'-phosphate
  modified_base 6: mod_base = OTHER; note = 2'-deoxy-2'-fluorouridine-3'-phosphate
  modified_base 7: mod_base = OTHER; note = 2'-O-methylcytidine-3'-phosphate
  modified_base 8: mod_base = OTHER; note = 2'-deoxy-2'-fluorouridine-3'-phosphate
  modified_base 9: mod_base = OTHER; note = 2'-O-methylguanosine-3'-phosphate
  modified_base 10: mod_base = OTHER; note = 2'-deoxy-2'-fluoroguanosine-3'-phosphate
  modified_base 11: mod_base = OTHER; note = 2'-O-methyluridine-3'-phosphate
  modified_base 12: mod_base = OTHER; note = 2'-deoxy-2'-fluorocytidine-3'-phosphate
  modified_base 13: mod_base = OTHER; note = 2'-O-methylcytidine-3'-phosphate
  modified_base 14: mod_base = OTHER; note = 2'-deoxy-2'-fluorouridine-3'-phosphate
  modified_base 15: mod_base = OTHER; note = 2'-O-methyluridine-3'-phosphate
  modified_base 16: mod_base = OTHER; note = 2'-deoxy-2'-fluoroadenosine-3'-phosphate
  modified_base 17: mod_base = OTHER; note = 2'-O-methylcytidine-3'-phosphate
  modified_base 18: mod_base = OTHER; note = 2'-deoxy-2'-fluorouridine-3'-phosphate
  modified_base 19: mod_base = OTHER; note = 2'-O-methyluridine-3'-phosphate
  modified_base 20: mod_base = OTHER; note = 2'-deoxythymidine-3'-phosphorothioate
  misc_feature 1..19: note = RNA
  misc_feature 20..21: note = DNA
ttgtctctggtccttactttt

SEQ ID NO: 233 - RNA, 21 nt, synthetic construct
  source 1..21: mol_type = other RNA
  modified_base 1: mod_base = OTHER; note = 2'-deoxy-2'-fluorocytidine-3'-phosphorothioate
  modified_base 2: mod_base = OTHER; note = 2'-O-methyladenosine-3'-phosphorothioate
  modified_base 3: mod_base = OTHER; note = 2'-deoxy-2'-fluoroguanosine-3'-phosphate
  modified_base 4: mod_base = OTHER; note = 2'-O-methylguanosine-3'-phosphate
  modified_base 5: mod_base = OTHER; note = 2'-deoxy-2'-fluoroadenosine-3'-phosphate
  modified_base 6: mod_base = OTHER; note = 2'-O-methyluridine-3'-phosphate
  modified_base 7: mod_base = OTHER; note = 2'-deoxy-2'-fluorocytidine-3'-phosphate
  modified_base 8: mod_base = OTHER; note = 2'-O-methyladenosine-3'-phosphate
  modified_base 9: mod_base = OTHER; note = 2'-deoxy-2'-fluorouridine-3'-phosphate
  modified_base 10: mod_base = OTHER; note = 2'-deoxy-2'-fluorocytidine-3'-phosphate
  modified_base 11: mod_base = OTHER; note = 2'-deoxy-2'-fluorouridine-3'-phosphate
  modified_base 12: mod_base = OTHER; note = 2'-O-methylcytidine-3'-phosphate
  modified_base 13: mod_base = OTHER; note = 2'-deoxy-2'-fluoroadenosine-3'-phosphate
  modified_base 14: mod_base = OTHER; note = 2'-O-methyladenosine-3'-phosphate
  modified_base 15: mod_base = OTHER; note = 2'-deoxy-2'-fluoroguanosine-3'-phosphate
  modified_base 16: mod_base = OTHER; note = 2'-O-methyluridine-3'-phosphate
  modified_base 17: mod_base = OTHER; note = 2'-deoxy-2'-fluorocytidine-3'-phosphate
  modified_base 18: mod_base = OTHER; note = 2'-O-methyluridine-3'-phosphate
  modified_base 19: mod_base = OTHER; note = 2'-deoxy-2'-fluorouridine-3'-phosphate
  modified_base 20: mod_base = OTHER; note = 2'-O-methyladenosine-3'-phosphate
  modified_base 21: mod_base = OTHER; note = 2'-deoxy-2'-fluorocytidine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
caggatcatctcaagtcttac

SEQ ID NO: 234 - RNA, 21 nt, synthetic construct
  source 1..21: mol_type = other RNA
  modified_base 1: mod_base = OTHER; note = 2'-deoxy-2'-fluorocytidine-3'-phosphorothioate
  modified_base 2: mod_base = OTHER; note = 2'-O-methyladenosine-3'-phosphorothioate
  modified_base 3: mod_base = OTHER; note = 2'-deoxy-2'-fluoroguanosine-3'-phosphate
  modified_base 4: mod_base = OTHER; note = 2'-O-methylguanosine-3'-phosphate
  modified_base 5: mod_base = OTHER; note = 2'-deoxy-2'-fluoroadenosine-3'-phosphate
  modified_base 6: mod_base = OTHER; note = 2'-O-methyluridine-3'-phosphate
  modified_base 7: mod_base = OTHER; note = 2'-deoxy-2'-fluorocytidine-3'-phosphate
  modified_base 8: mod_base = OTHER; note = 2'-O-methyladenosine-3'-phosphate
  modified_base 9: mod_base = OTHER; note = 2'-deoxy-2'-fluorouridine-3'-phosphate
  modified_base 10: mod_base = OTHER; note = 2'-deoxy-2'-fluorocytidine-3'-phosphate
  modified_base 11: mod_base = OTHER; note = 2'-deoxy-2'-fluorouridine-3'-phosphate
  modified_base 12: mod_base = OTHER; note = 2'-O-methylcytidine-3'-phosphate
  modified_base 13: mod_base = OTHER; note = 2'-deoxy-2'-fluoroadenosine-3'-phosphate
  modified_base 14: mod_base = OTHER; note = 2'-O-methyladenosine-3'-phosphate
  modified_base 15: mod_base = OTHER; note = 2'-deoxy-2'-fluoroguanosine-3'-phosphate
  modified_base 16: mod_base = OTHER; note = 2'-O-methyluridine-3'-phosphate
  modified_base 17: mod_base = OTHER; note = 2'-deoxy-2'-fluorocytidine-3'-phosphate
  modified_base 19: mod_base = OTHER; note = 2'-deoxy-2'-fluorouridine-3'-phosphate
  modified_base 20: mod_base = OTHER; note = 2'-O-methyladenosine-3'-phosphate
  modified_base 21: mod_base = OTHER; note = 2'-deoxy-2'-fluoroadenosine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
caggatcatctcaagtcttaa

SEQ ID NO: 235 - RNA, 21 nt, synthetic construct
  source 1..21: mol_type = other RNA
  modified_base 1: mod_base = OTHER; note = 2'-deoxy-2'-fluorocytidine-3'-phosphorothioate
  modified_base 2: mod_base = OTHER; note = 2'-O-methyladenosine-3'-phosphorothioate
  modified_base 3: mod_base = OTHER; note = 2'-deoxy-2'-fluoroguanosine-3'-phosphate
  modified_base 4: mod_base = OTHER; note = 2'-O-methylguanosine-3'-phosphate
  modified_base 5: mod_base = OTHER; note = 2'-deoxy-2'-fluoroadenosine-3'-phosphate
  modified_base 6: mod_base = OTHER; note = 2'-O-methyluridine-3'-phosphate
  modified_base 7: mod_base = OTHER; note = 2'-deoxy-2'-fluorocytidine-3'-phosphate
  modified_base 8: mod_base = OTHER; note = 2'-O-methyladenosine-3'-phosphate
  modified_base 9: mod_base = OTHER; note = 2'-deoxy-2'-fluorouridine-3'-phosphate
  modified_base 10: mod_base = OTHER; note = 2'-deoxy-2'-fluorocytidine-3'-phosphate
  modified_base 11: mod_base = OTHER; note = 2'-deoxy-2'-fluorouridine-3'-phosphate
  modified_base 12: mod_base = OTHER; note = 2'-O-methylcytidine-3'-phosphate
  modified_base 13: mod_base = OTHER; note = 2'-deoxy-2'-fluoroadenosine-3'-phosphate
  modified_base 14: mod_base = OTHER; note = 2'-O-methyladenosine-3'-phosphate
  modified_base 15: mod_base = OTHER; note = 2'-deoxy-2'-fluoroguanosine-3'-phosphate
  modified_base 16: mod_base = OTHER; note = 2'-O-methyluridine-3'-phosphate
  modified_base 17: mod_base = OTHER; note = 2'-deoxy-2'-fluorocytidine-3'-phosphate
  modified_base 19: mod_base = OTHER; note = 2'-fluoro-5'-(S)-methyl-uridine-3'-phosphate
  modified_base 20: mod_base = OTHER; note = 2'-O-methyladenosine-3'-phosphate
  modified_base 21: mod_base = OTHER; note = 2'-deoxy-2'-fluoroadenosine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
caggatcatctcaagtcttaa

SEQ ID NO: 236 - RNA, 21 nt, synthetic construct
  source 1..21: mol_type = other RNA
  modified_base 1: mod_base = OTHER; note = 2'-deoxy-2'-fluorocytidine-3'-phosphorothioate
  modified_base 2: mod_base = OTHER; note = 2'-O-methyladenosine-3'-phosphorothioate
  modified_base 3: mod_base = OTHER; note = 2'-deoxy-2'-fluoroguanosine-3'-phosphate
  modified_base 4: mod_base = OTHER; note = 2'-O-methylguanosine-3'-phosphate
  modified_base 5: mod_base = OTHER; note = 2'-deoxy-2'-fluoroadenosine-3'-phosphate
  modified_base 6: mod_base = OTHER; note = 2'-O-methyluridine-3'-phosphate
  modified_base 7: mod_base = OTHER; note = 2'-deoxy-2'-fluorocytidine-3'-phosphate
  modified_base 8: mod_base = OTHER; note = 2'-O-methyladenosine-3'-phosphate
  modified_base 9: mod_base = OTHER; note = 2'-deoxy-2'-fluorouridine-3'-phosphate
  modified_base 10: mod_base = OTHER; note = 2'-deoxy-2'-fluorocytidine-3'-phosphate
  modified_base 11: mod_base = OTHER; note = 2'-deoxy-2'-fluorouridine-3'-phosphate
  modified_base 12: mod_base = OTHER; note = 2'-O-methylcytidine-3'-phosphate
  modified_base 13: mod_base = OTHER; note = 2'-deoxy-2'-fluoroadenosine-3'-phosphate
  modified_base 14: mod_base = OTHER; note = 2'-O-methyladenosine-3'-phosphate
  modified_base 15: mod_base = OTHER; note = 2'-deoxy-2'-fluoroguanosine-3'-phosphate
  modified_base 16: mod_base = OTHER; note = 2'-O-methyluridine-3'-phosphate
  modified_base 17: mod_base = OTHER; note = 2'-deoxy-2'-fluorocytidine-3'-phosphate
  modified_base 19: mod_base = OTHER; note = 2'-fluoro-5'-(R)-methyl-uridine-3'-phosphate
  modified_base 20: mod_base = OTHER; note = 2'-O-methyladenosine-3'-phosphate
  modified_base 21: mod_base = OTHER; note = 2'-deoxy-2'-fluoroadenosine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
caggatcatctcaagtcttaa

SEQ ID NO: 237 - RNA, 21 nt, synthetic construct
  source 1..21: mol_type = other RNA
  modified_base 1: mod_base = OTHER; note = 2'-deoxy-2'-fluorocytidine-3'-phosphorothioate
  modified_base 2: mod_base = OTHER; note = 2'-O-methyladenosine-3'-phosphorothioate
  modified_base 3: mod_base = OTHER; note = 2'-deoxy-2'-fluoroguanosine-3'-phosphate
  modified_base 4: mod_base = OTHER; note = 2'-O-methylguanosine-3'-phosphate
  modified_base 5: mod_base = OTHER; note = 2'-deoxy-2'-fluoroadenosine-3'-phosphate
  modified_base 6: mod_base = OTHER; note = 2'-O-methyluridine-3'-phosphate
  modified_base 7: mod_base = OTHER; note = 2'-deoxy-2'-fluorocytidine-3'-phosphate
  modified_base 8: mod_base = OTHER; note = 2'-O-methyladenosine-3'-phosphate
  modified_base 9: mod_base = OTHER; note = 2'-deoxy-2'-fluorouridine-3'-phosphate
  modified_base 10: mod_base = OTHER; note = 2'-deoxy-2'-fluorocytidine-3'-phosphate
  modified_base 11: mod_base = OTHER; note = 2'-deoxy-2'-fluorouridine-3'-phosphate
  modified_base 12: mod_base = OTHER; note = 2'-O-methylcytidine-3'-phosphate
  modified_base 13: mod_base = OTHER; note = 2'-deoxy-2'-fluoroadenosine-3'-phosphate
  modified_base 14: mod_base = OTHER; note = 2'-O-methyladenosine-3'-phosphate
  modified_base 15: mod_base = OTHER; note = 2'-deoxy-2'-fluoroguanosine-3'-phosphate
  modified_base 16: mod_base = OTHER; note = 2'-O-methyluridine-3'-phosphate
  modified_base 17: mod_base = OTHER; note = 2'-deoxy-2'-fluorocytidine-3'-phosphate
  modified_base 19: mod_base = OTHER; note = 2'-O-methyl-5'-(S)-methyl-uridine-3'-phosphate
  modified_base 20: mod_base = OTHER; note = 2'-O-methyladenosine-3'-phosphate
  modified_base 21: mod_base = OTHER; note = 2'-deoxy-2'-fluoroadenosine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
caggatcatctcaagtcttaa

SEQ ID NO: 238 - RNA, 21 nt, synthetic construct
  source 1..21: mol_type = other RNA
  modified_base 1: mod_base = OTHER; note = 2'-deoxy-2'-fluorocytidine-3'-phosphorothioate
  modified_base 2: mod_base = OTHER; note = 2'-O-methyladenosine-3'-phosphorothioate
  modified_base 3: mod_base = OTHER; note = 2'-deoxy-2'-fluoroguanosine-3'-phosphate
  modified_base 4: mod_base = OTHER; note = 2'-O-methylguanosine-3'-phosphate
  modified_base 5: mod_base = OTHER; note = 2'-deoxy-2'-fluoroadenosine-3'-phosphate
  modified_base 6: mod_base = OTHER; note = 2'-O-methyluridine-3'-phosphate
  modified_base 7: mod_base = OTHER; note = 2'-deoxy-2'-fluorocytidine-3'-phosphate
  modified_base 8: mod_base = OTHER; note = 2'-O-methyladenosine-3'-phosphate
  modified_base 9: mod_base = OTHER; note = 2'-deoxy-2'-fluorouridine-3'-phosphate
  modified_base 10: mod_base = OTHER; note = 2'-deoxy-2'-fluorocytidine-3'-phosphate
  modified_base 11: mod_base = OTHER; note = 2'-deoxy-2'-fluorouridine-3'-phosphate
  modified_base 12: mod_base = OTHER; note = 2'-O-methylcytidine-3'-phosphate
  modified_base 13: mod_base = OTHER; note = 2'-deoxy-2'-fluoroadenosine-3'-phosphate
  modified_base 14: mod_base = OTHER; note = 2'-O-methyladenosine-3'-phosphate
  modified_base 15: mod_base = OTHER; note = 2'-deoxy-2'-fluoroguanosine-3'-phosphate
  modified_base 16: mod_base = OTHER; note = 2'-O-methyluridine-3'-phosphate
  modified_base 17: mod_base = OTHER; note = 2'-deoxy-2'-fluorocytidine-3'-phosphate
  modified_base 19: mod_base = OTHER; note = 2'-O-methyl-5'-(R)-methyl-uridine-3'-phosphate
  modified_base 20: mod_base = OTHER; note = 2'-O-methyladenosine-3'-phosphate
  modified_base 21: mod_base = OTHER; note = 2'-deoxy-2'-fluoroadenosine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
caggatcatctcaagtcttaa

SEQ ID NO: 239 - RNA, 21 nt, synthetic construct
  source 1..21: mol_type = other RNA
  modified_base 1: mod_base = OTHER; note = 2'-deoxy-2'-fluorocytidine-3'-phosphorothioate
  modified_base 2: mod_base = OTHER; note = 2'-O-methyladenosine-3'-phosphorothioate
  modified_base 3: mod_base = OTHER; note = 2'-deoxy-2'-fluoroguanosine-3'-phosphate
  modified_base 4: mod_base = OTHER; note = 2'-O-methylguanosine-3'-phosphate
  modified_base 5: mod_base = OTHER; note = 2'-deoxy-2'-fluoroadenosine-3'-phosphate
  modified_base 6: mod_base = OTHER; note = 2'-O-methyluridine-3'-phosphate
  modified_base 7: mod_base = OTHER; note = 2'-deoxy-2'-fluorocytidine-3'-phosphate
  modified_base 8: mod_base = OTHER; note = 2'-O-methyladenosine-3'-phosphate
  modified_base 9: mod_base = OTHER; note = 2'-deoxy-2'-fluorouridine-3'-phosphate
  modified_base 10: mod_base = OTHER; note = 2'-deoxy-2'-fluorocytidine-3'-phosphate
  modified_base 11: mod_base = OTHER; note = 2'-deoxy-2'-fluorouridine-3'-phosphate
  modified_base 12: mod_base = OTHER; note = 2'-O-methylcytidine-3'-phosphate
  modified_base 13: mod_base = OTHER; note = 2'-deoxy-2'-fluoroadenosine-3'-phosphate
  modified_base 14: mod_base = OTHER; note = 2'-O-methyladenosine-3'-phosphate
  modified_base 15: mod_base = OTHER; note = 2'-deoxy-2'-fluoroguanosine-3'-phosphate
  modified_base 16: mod_base = OTHER; note = 2'-O-methyluridine-3'-phosphate
  modified_base 17: mod_base = OTHER; note = 2'-deoxy-2'-fluorocytidine-3'-phosphate
  modified_base 19: mod_base = OTHER; note = 5'-(S)-methyl-deoxythymidine-3'-phosphate
  modified_base 20: mod_base = OTHER; note = 2'-O-methyladenosine-3'-phosphate
  modified_base 21: mod_base = OTHER; note = 2'-deoxy-2'-fluoroadenosine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
caggatcatctcaagtcttaa

SEQ ID NO: 240 - RNA, 21 nt, synthetic construct
  source 1..21: mol_type = other RNA
  modified_base 1: mod_base = OTHER; note = 2'-deoxy-2'-fluorocytidine-3'-phosphorothioate
  modified_base 2: mod_base = OTHER; note = 2'-O-methyladenosine-3'-phosphorothioate
  modified_base 3: mod_base = OTHER; note = 2'-deoxy-2'-fluoroguanosine-3'-phosphate
  modified_base 4: mod_base = OTHER; note = 2'-O-methylguanosine-3'-phosphate
  modified_base 5: mod_base = OTHER; note = 2'-deoxy-2'-fluoroadenosine-3'-phosphate
  modified_base 6: mod_base = OTHER; note = 2'-O-methyluridine-3'-phosphate
  modified_base 7: mod_base = OTHER; note = 2'-deoxy-2'-fluorocytidine-3'-phosphate
  modified_base 8: mod_base = OTHER; note = 2'-O-methyladenosine-3'-phosphate
  modified_base 9: mod_base = OTHER; note = 2'-deoxy-2'-fluorouridine-3'-phosphate
  modified_base 10: mod_base = OTHER; note = 2'-deoxy-2'-fluorocytidine-3'-phosphate
  modified_base 11: mod_base = OTHER; note = 2'-deoxy-2'-fluorouridine-3'-phosphate
  modified_base 12: mod_base = OTHER; note = 2'-O-methylcytidine-3'-phosphate
  modified_base 13: mod_base = OTHER; note = 2'-deoxy-2'-fluoroadenosine-3'-phosphate
  modified_base 14: mod_base = OTHER; note = 2'-O-methyladenosine-3'-phosphate
  modified_base 15: mod_base = OTHER; note = 2'-deoxy-2'-fluoroguanosine-3'-phosphate
  modified_base 16: mod_base = OTHER; note = 2'-O-methyluridine-3'-phosphate
  modified_base 17: mod_base = OTHER; note = 2'-deoxy-2'-fluorocytidine-3'-phosphate
  modified_base 19: mod_base = OTHER; note = 5'-(R)-methyl-deoxythymidine-3'-phosphate
  modified_base 20: mod_base = OTHER; note = 2'-O-methyladenosine-3'-phosphate
  modified_base 21: mod_base = OTHER; note = 2'-deoxy-2'-fluoroadenosine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
caggatcatctcaagtcttaa

SEQ ID NO: 241 - RNA, 21 nt, synthetic construct
  source 1..21: mol_type = other RNA
  modified_base 1: mod_base = OTHER; note = 2'-deoxy-2'-fluorocytidine-3'-phosphorothioate
  modified_base 2: mod_base = OTHER; note = 2'-O-methyladenosine-3'-phosphorothioate
  modified_base 3: mod_base = OTHER; note = 2'-deoxy-2'-fluoroguanosine-3'-phosphate
  modified_base 4: mod_base = OTHER; note = 2'-O-methylguanosine-3'-phosphate
  modified_base 5: mod_base = OTHER; note = 2'-deoxy-2'-fluoroadenosine-3'-phosphate
  modified_base 6: mod_base = OTHER; note = 2'-O-methyluridine-3'-phosphate
  modified_base 7: mod_base = OTHER; note = 2'-deoxy-2'-fluorocytidine-3'-phosphate
  modified_base 8: mod_base = OTHER; note = 2'-O-methyladenosine-3'-phosphate
  modified_base 9: mod_base = OTHER; note = 2'-deoxy-2'-fluorouridine-3'-phosphate
  modified_base 10: mod_base = OTHER; note = 2'-deoxy-2'-fluorocytidine-3'-phosphate
  modified_base 11: mod_base = OTHER; note = 2'-deoxy-2'-fluorouridine-3'-phosphate
  modified_base 12: mod_base = OTHER; note = 2'-O-methylcytidine-3'-phosphate
  modified_base 13: mod_base = OTHER; note = 2'-deoxy-2'-fluoroadenosine-3'-phosphate
  modified_base 14: mod_base = OTHER; note = 2'-O-methyladenosine-3'-phosphate
  modified_base 15: mod_base = OTHER; note = 2'-deoxy-2'-fluoroguanosine-3'-phosphate
  modified_base 16: mod_base = OTHER; note = 2'-O-methyluridine-3'-phosphate
  modified_base 17: mod_base = OTHER; note = 2'-deoxy-2'-fluorocytidine-3'-phosphate
  modified_base 19: mod_base = OTHER; note = 2'-fluoro-4'-methoxyuridine-3'-phosphate
  modified_base 20: mod_base = OTHER; note = 2'-O-methyladenosine-3'-phosphate
  modified_base 21: mod_base = OTHER; note = 2'-deoxy-2'-fluoroadenosine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
caggatcatctcaagtcttaa

SEQ ID NO: 242 - DNA, 21 bp, synthetic construct
  source 1..21: mol_type = other DNA
  modified_base 1: mod_base = OTHER; note = 2'-deoxy-2'-fluorocytidine-3'-phosphorothioate
  modified_base 2: mod_base = OTHER; note = 2'-O-methyladenosine-3'-phosphorothioate
  modified_base 3: mod_base = OTHER; note = 2'-deoxy-2'-fluoroguanosine-3'-phosphate
  modified_base 4: mod_base = OTHER; note = 2'-O-methylguanosine-3'-phosphate
  modified_base 5: mod_base = OTHER; note = 2'-deoxy-2'-fluoroadenosine-3'-phosphate
  modified_base 6: mod_base = OTHER; note = 2'-O-methyluridine-3'-phosphate
  modified_base 7: mod_base = OTHER; note = 2'-deoxy-2'-fluorocytidine-3'-phosphate
  modified_base 8: mod_base = OTHER; note = 2'-O-methyladenosine-3'-phosphate
  modified_base 9: mod_base = OTHER; note = 2'-deoxy-2'-fluorouridine-3'-phosphate
  modified_base 10: mod_base = OTHER; note = 2'-deoxy-2'-fluorocytidine-3'-phosphate
  modified_base 11: mod_base = OTHER; note = 2'-deoxy-2'-fluorouridine-3'-phosphate
  modified_base 12: mod_base = OTHER; note = 2'-O-methylcytidine-3'-phosphate
  modified_base 13: mod_base = OTHER; note = 2'-deoxy-2'-fluoroadenosine-3'-phosphate
  modified_base 14: mod_base = OTHER; note = 2'-O-methyladenosine-3'-phosphate
  modified_base 15: mod_base = OTHER; note = 2'-deoxy-2'-fluoroguanosine-3'-phosphate
  modified_base 16: mod_base = OTHER; note = 2'-O-methyluridine-3'-phosphate
  modified_base 17: mod_base = OTHER; note = 2'-deoxy-2'-fluorocytidine-3'-phosphate
  modified_base 18: mod_base = OTHER; note = uridine-3'-phosphate
  modified_base 19: mod_base = OTHER; note = 4'-methoxy-2'-deoxythymidine-3'-phosphate
  modified_base 20: mod_base = OTHER; note = 2'-O-methyladenosine-3'-phosphate
  modified_base 21: mod_base = OTHER; note = 2'-deoxy-2'-fluoroadenosine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
  misc_feature 1..18: note = RNA
  misc_feature 20..21: note = RNA
  misc_feature 19: note = DNA
caggatcatctcaagtcttaa

SEQ ID NO: 243 - RNA, 21 nt, synthetic construct
  source 1..21: mol_type = other RNA
  modified_base 1: mod_base = OTHER; note = 2'-deoxy-2'-fluorocytidine-3'-phosphorothioate
  modified_base 2: mod_base = OTHER; note = 2'-O-methyladenosine-3'-phosphorothioate
  modified_base 3: mod_base = OTHER; note = 2'-deoxy-2'-fluoroguanosine-3'-phosphate
  modified_base 4: mod_base = OTHER; note = 2'-O-methylguanosine-3'-phosphate
  modified_base 5: mod_base = OTHER; note = 2'-deoxy-2'-fluoroadenosine-3'-phosphate
  modified_base 6: mod_base = OTHER; note = 2'-O-methyluridine-3'-phosphate
  modified_base 7: mod_base = OTHER; note = 2'-deoxy-2'-fluorocytidine-3'-phosphate
  modified_base 8: mod_base = OTHER; note = 2'-O-methyladenosine-3'-phosphate
  modified_base 9: mod_base = OTHER; note = 2'-deoxy-2'-fluorouridine-3'-phosphate
  modified_base 10: mod_base = OTHER; note = 2'-deoxy-2'-fluorocytidine-3'-phosphate
  modified_base 11: mod_base = OTHER; note = 2'-deoxy-2'-fluorouridine-3'-phosphate
  modified_base 12: mod_base = OTHER; note = 2'-O-methylcytidine-3'-phosphate
  modified_base 13: mod_base = OTHER; note = 2'-deoxy-2'-fluoroadenosine-3'-phosphate
  modified_base 14: mod_base = OTHER; note = 2'-O-methyladenosine-3'-phosphate
  modified_base 15: mod_base = OTHER; note = 2'-deoxy-2'-fluoroguanosine-3'-phosphate
  modified_base 16: mod_base = OTHER; note = 2'-O-methyluridine-3'-phosphate
  modified_base 17: mod_base = OTHER; note = 2'-deoxy-2'-fluorocytidine-3'-phosphate
  modified_base 19: mod_base = OTHER; note = 2'-O-methyluridine-3'-phosphate
  modified_base 20: mod_base = OTHER; note = 2'-O-methyladenosine-3'-phosphate
  modified_base 21: mod_base = OTHER; note = 2'-deoxy-2'-fluoroadenosine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
caggatcatctcaagtcttaa

SEQ ID NO: 244 - DNA, 21 bp, synthetic construct
  source 1..21: mol_type = other DNA
  modified_base 1: mod_base = OTHER; note = 2'-deoxy-2'-fluorocytidine-3'-phosphorothioate
  modified_base 2: mod_base = OTHER; note = 2'-O-methyladenosine-3'-phosphorothioate
  modified_base 3: mod_base = OTHER; note = 2'-deoxy-2'-fluoroguanosine-3'-phosphate
  modified_base 4: mod_base = OTHER; note = 2'-O-methylguanosine-3'-phosphate
  modified_base 5: mod_base = OTHER; note = 2'-deoxy-2'-fluoroadenosine-3'-phosphate
  modified_base 6: mod_base = OTHER; note = 2'-O-methyluridine-3'-phosphate
  modified_base 7: mod_base = OTHER; note = 2'-deoxy-2'-fluorocytidine-3'-phosphate
  modified_base 8: mod_base = OTHER; note = 2'-O-methyladenosine-3'-phosphate
  modified_base 9: mod_base = OTHER; note = 2'-deoxy-2'-fluorouridine-3'-phosphate
  modified_base 10: mod_base = OTHER; note = 2'-deoxy-2'-fluorocytidine-3'-phosphate
  modified_base 11: mod_base = OTHER; note = 2'-deoxy-2'-fluorouridine-3'-phosphate
  modified_base 12: mod_base = OTHER; note = 2'-O-methylcytidine-3'-phosphate
  modified_base 13: mod_base = OTHER; note = 2'-deoxy-2'-fluoroadenosine-3'-phosphate
  modified_base 14: mod_base = OTHER; note = 2'-O-methyladenosine-3'-phosphate
  modified_base 15: mod_base = OTHER; note = 2'-deoxy-2'-fluoroguanosine-3'-phosphate
  modified_base 16: mod_base = OTHER; note = 2'-O-methyluridine-3'-phosphate
  modified_base 17: mod_base = OTHER; note = 2'-deoxy-2'-fluorocytidine-3'-phosphate
  modified_base 18: mod_base = OTHER; note = uridine-3'-phosphate
  modified_base 20: mod_base = OTHER; note = 2'-O-methyladenosine-3'-phosphate
  modified_base 21: mod_base = OTHER; note = 2'-deoxy-2'-fluoroadenosine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
  misc_feature 1..18: note = RNA
  misc_feature 20..21: note = RNA
  misc_feature 19: note = DNA
caggatcatctcaagtcttaa

SEQ ID NO: 245 - RNA, 21 nt, synthetic construct
  source 1..21: mol_type = other RNA
  modified_base 1: mod_base = OTHER; note = 2'-deoxy-2'-fluorocytidine-3'-phosphorothioate
  modified_base 2: mod_base = OTHER; note = 2'-O-methyladenosine-3'-phosphorothioate
  modified_base 3: mod_base = OTHER; note = 2'-deoxy-2'-fluoroguanosine-3'-phosphate
  modified_base 4: mod_base = OTHER; note = 2'-O-methylguanosine-3'-phosphate
  modified_base 5: mod_base = OTHER; note = 2'-deoxy-2'-fluoroadenosine-3'-phosphate
  modified_base 6: mod_base = OTHER; note = 2'-O-methyluridine-3'-phosphate
  modified_base 7: mod_base = OTHER; note = 2'-deoxy-2'-fluorocytidine-3'-phosphate
  modified_base 8: mod_base = OTHER; note = 2'-O-methyladenosine-3'-phosphate
  modified_base 9: mod_base = OTHER; note = 2'-deoxy-2'-fluorouridine-3'-phosphate
  modified_base 10: mod_base = OTHER; note = 2'-deoxy-2'-fluorocytidine-3'-phosphate
  modified_base 11: mod_base = OTHER; note = 2'-deoxy-2'-fluorouridine-3'-phosphate
  modified_base 12: mod_base = OTHER; note = 2'-O-methylcytidine-3'-phosphate
  modified_base 13: mod_base = OTHER; note = 2'-deoxy-2'-fluoroadenosine-3'-phosphate
  modified_base 14: mod_base = OTHER; note = 2'-O-methyladenosine-3'-phosphate
  modified_base 15: mod_base = OTHER; note = 2'-deoxy-2'-fluoroguanosine-3'-phosphate
  modified_base 16: mod_base = OTHER; note = 2'-O-methyluridine-3'-phosphate
  modified_base 17: mod_base = OTHER; note = 2'-deoxy-2'-fluorocytidine-3'-phosphate
  modified_base 18: mod_base = OTHER; note = 2'-O-methyluridine-3'-phosphate
  modified_base 19: mod_base = OTHER; note = 2'-deoxy-2'-fluorouridine-3'-phosphate
  modified_base 20: mod_base = OTHER; note = 2'-O-methyladenosine-3'-phosphate
  modified_base 21: mod_base = OTHER; note = 2'-deoxy-2'-fluoroadenosine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
caggatcatctcaagtcttaa

SEQ ID NO: 246 - RNA, 21 nt, synthetic construct
  source 1..21: mol_type = other RNA
  modified_base 1: mod_base = OTHER; note = 2'-deoxy-2'-fluorocytidine-3'-phosphorothioate
  modified_base 2: mod_base = OTHER; note = 2'-O-methyladenosine-3'-phosphorothioate
  modified_base 3: mod_base = OTHER; note = 2'-deoxy-2'-fluoroguanosine-3'-phosphate
  modified_base 4: mod_base = OTHER; note = 2'-O-methylguanosine-3'-phosphate
  modified_base 5: mod_base = OTHER; note = 2'-deoxy-2'-fluoroadenosine-3'-phosphate
  modified_base 6: mod_base = OTHER; note = 2'-O-methyluridine-3'-phosphate
  modified_base 7: mod_base = OTHER; note = 2'-deoxy-2'-fluorocytidine-3'-phosphate
  modified_base 8: mod_base = OTHER; note = 2'-O-methyladenosine-3'-phosphate
  modified_base 9: mod_base = OTHER; note = 2'-deoxy-2'-fluorouridine-3'-phosphate
  modified_base 10: mod_base = OTHER; note = 2'-deoxy-2'-fluorocytidine-3'-phosphate
  modified_base 11: mod_base = OTHER; note = 2'-deoxy-2'-fluorouridine-3'-phosphate
  modified_base 12: mod_base = OTHER; note = 2'-O-methylcytidine-3'-phosphate
  modified_base 13: mod_base = OTHER; note = 2'-deoxy-2'-fluoroadenosine-3'-phosphate
  modified_base 14: mod_base = OTHER; note = 2'-O-methyladenosine-3'-phosphate
  modified_base 15: mod_base = OTHER; note = 2'-deoxy-2'-fluoroguanosine-3'-phosphate
  modified_base 16: mod_base = OTHER; note = 2'-O-methyluridine-3'-phosphate
  modified_base 17: mod_base = OTHER; note = 2'-deoxy-2'-fluorocytidine-3'-phosphate
  modified_base 18: mod_base = OTHER; note = 2'-O-methyluridine-3'-phosphate
  modified_base 19: mod_base = OTHER; note = 2'-deoxy-2'-fluorouridine-3'-phosphate
  modified_base 20: mod_base = OTHER; note = 2'-O-methyladenosine-3'-phosphate
  modified_base 21: mod_base = OTHER; note = 2'-deoxy-2'-fluoroadenosine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
caggatcatctcaagtcttaa

SEQ ID NO: 247 - RNA, 21 nt, synthetic construct
  source 1..21: mol_type = other RNA
  modified_base 1: mod_base = OTHER; note = 2'-deoxy-2'-fluorocytidine-3'-phosphorothioate
  modified_base 2: mod_base = OTHER; note = 2'-O-methyladenosine-3'-phosphorothioate
  modified_base 3: mod_base = OTHER; note = 2'-deoxy-2'-fluoroguanosine-3'-phosphate
  modified_base 4: mod_base = OTHER; note = 2'-O-methylguanosine-3'-phosphate
  modified_base 5: mod_base = OTHER; note = 2'-deoxy-2'-fluoroadenosine-3'-phosphate
  modified_base 6: mod_base = OTHER; note = 2'-O-methyluridine-3'-phosphate
  modified_base 7: mod_base = OTHER; note = 2'-deoxy-2'-fluorocytidine-3'-phosphate
  modified_base 8: mod_base = OTHER; note = 2'-O-methyladenosine-3'-phosphate
  modified_base 9: mod_base = OTHER; note = 2'-deoxy-2'-fluorouridine-3'-phosphate
  modified_base 10: mod_base = OTHER; note = 2'-deoxy-2'-fluorocytidine-3'-phosphate
  modified_base 11: mod_base = OTHER; note = 2'-deoxy-2'-fluorouridine-3'-phosphate
  modified_base 12: mod_base = OTHER; note = 2'-O-methylcytidine-3'-phosphate
  modified_base 13: mod_base = OTHER; note = 2'-deoxy-2'-fluoroadenosine-3'-phosphate
  modified_base 14: mod_base = OTHER; note = 2'-O-methyladenosine-3'-phosphate
  modified_base 15: mod_base = OTHER; note = 2'-deoxy-2'-fluoroguanosine-3'-phosphate
  modified_base 16: mod_base = OTHER; note = 2'-O-methyluridine-3'-phosphate
  modified_base 17: mod_base = OTHER; note = 2'-deoxy-2'-fluorocytidine-3'-phosphate
  modified_base 18: mod_base = OTHER; note = 2'-O-methyluridine-3'-phosphate
  modified_base 19: mod_base = OTHER; note = 2'-deoxy-2'-fluorouridine-3'-phosphate
  modified_base 20: mod_base = OTHER; note = 2'-O-methyladenosine-3'-phosphate
  modified_base 21: mod_base = OTHER; note = 2'-deoxy-2'-fluoroadenosine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
caggatcatctcaagtcttaa

SEQ ID NO: 248 - RNA, 21 nt, synthetic construct
  source 1..21: mol_type = other RNA
  modified_base 1: mod_base = OTHER; note = 2'-deoxy-2'-fluorocytidine-3'-phosphorothioate
  modified_base 2: mod_base = OTHER; note = 2'-O-methyladenosine-3'-phosphorothioate
  modified_base 3: mod_base = OTHER; note = 2'-deoxy-2'-fluoroguanosine-3'-phosphate
  modified_base 4: mod_base = OTHER; note = 2'-O-methylguanosine-3'-phosphate
  modified_base 5: mod_base = OTHER; note = 2'-deoxy-2'-fluoroadenosine-3'-phosphate
  modified_base 6: mod_base = OTHER; note = 2'-O-methyluridine-3'-phosphate
  modified_base 7: mod_base = OTHER; note = 2'-deoxy-2'-fluorocytidine-3'-phosphate
  modified_base 8: mod_base = OTHER; note = 2'-O-methyladenosine-3'-phosphate
  modified_base 9: mod_base = OTHER; note = 2'-deoxy-2'-fluorouridine-3'-phosphate
  modified_base 10: mod_base = OTHER; note = 2'-deoxy-2'-fluorocytidine-3'-phosphate
  modified_base 11: mod_base = OTHER; note = 2'-deoxy-2'-fluorouridine-3'-phosphate
  modified_base 12: mod_base = OTHER; note = 2'-O-methylcytidine-3'-phosphate
  modified_base 13: mod_base = OTHER; note = 2'-deoxy-2'-fluoroadenosine-3'-phosphate
  modified_base 14: mod_base = OTHER; note = 2'-O-methyladenosine-3'-phosphate
  modified_base 15: mod_base = OTHER; note = 2'-deoxy-2'-fluoroguanosine-3'-phosphate
  modified_base 16: mod_base = OTHER; note = 2'-O-methyluridine-3'-phosphate
  modified_base 17: mod_base = OTHER; note = 2'-deoxy-2'-fluorocytidine-3'-phosphate
  modified_base 18: mod_base = OTHER; note = 2'-O-methyluridine-3'-phosphate
  modified_base 19: mod_base = OTHER; note = 2'-deoxy-2'-fluorouridine-3'-phosphate
  modified_base 20: mod_base = OTHER; note = 2'-O-methyladenosine-3'-phosphate
  modified_base 21: mod_base = OTHER; note = 2'-deoxy-2'-fluoroadenosine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
caggatcatctcaagtcttaa

SEQ ID NO: 249 - RNA, 21 nt, synthetic construct
  source 1..21: mol_type = other RNA
  modified_base 1: mod_base = OTHER; note = 2'-deoxy-2'-fluorocytidine-3'-phosphorothioate
  modified_base 2: mod_base = OTHER; note = 2'-O-methyladenosine-3'-phosphorothioate
  modified_base 3: mod_base = OTHER; note = 2'-deoxy-2'-fluoroguanosine-3'-phosphate
  modified_base 4: mod_base = OTHER; note = 2'-O-methylguanosine-3'-phosphate
  modified_base 5: mod_base = OTHER; note = 2'-deoxy-2'-fluoroadenosine-3'-phosphate
  modified_base 6: mod_base = OTHER; note = 2'-O-methyluridine-3'-phosphate
  modified_base 7: mod_base = OTHER; note = 2'-deoxy-2'-fluorocytidine-3'-phosphate
  modified_base 8: mod_base = OTHER; note = 2'-O-methyladenosine-3'-phosphate
  modified_base 9: mod_base = OTHER; note = 2'-deoxy-2'-fluorouridine-3'-phosphate
  modified_base 10: mod_base = OTHER; note = 2'-deoxy-2'-fluorocytidine-3'-phosphate
  modified_base 11: mod_base = OTHER; note = 2'-deoxy-2'-fluorouridine-3'-phosphate
  modified_base 12: mod_base = OTHER; note = 2'-O-methylcytidine-3'-phosphate
  modified_base 13: mod_base = OTHER; note = 2'-deoxy-2'-fluoroadenosine-3'-phosphate
  modified_base 14: mod_base = OTHER; note = 2'-O-methyladenosine-3'-phosphate
  modified_base 15: mod_base = OTHER; note = 2'-deoxy-2'-fluoroguanosine-3'-phosphate
  modified_base 16: mod_base = OTHER; note = 2'-O-methyluridine-3'-phosphate
  modified_base 17: mod_base = OTHER; note = 2'-deoxy-2'-fluorocytidine-3'-phosphate
  modified_base 18: mod_base = OTHER; note = 2'-O-methyluridine-3'-phosphate
  modified_base 19: mod_base = OTHER; note = 2'-deoxy-2'-fluorouridine-3'-phosphate
  modified_base 20: mod_base = OTHER; note = 2'-O-methyladenosine-3'-phosphate
  modified_base 21: mod_base = OTHER; note = 2'-deoxy-2'-fluoroadenosine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
caggatcatctcaagtcttaa

SEQ ID NO: 250 - RNA, 21 nt, synthetic construct
  source 1..21: mol_type = other RNA
  modified_base 1: mod_base = OTHER; note = 2'-deoxy-2'-fluorocytidine-3'-phosphorothioate
  modified_base 2: mod_base = OTHER; note = 2'-O-methyladenosine-3'-phosphorothioate
  modified_base 3: mod_base = OTHER; note = 2'-deoxy-2'-fluoroguanosine-3'-phosphate
  modified_base 4: mod_base = OTHER; note = 2'-O-methylguanosine-3'-phosphate
  modified_base 5: mod_base = OTHER; note = 2'-deoxy-2'-fluoroadenosine-3'-phosphate
  modified_base 6: mod_base = OTHER; note = 2'-O-methyluridine-3'-phosphate
  modified_base 7: mod_base = OTHER; note = 2'-deoxy-2'-fluorocytidine-3'-phosphate
  modified_base 8: mod_base = OTHER; note = 2'-O-methyladenosine-3'-phosphate
  modified_base 9: mod_base = OTHER; note = 2'-deoxy-2'-fluorouridine-3'-phosphate
  modified_base 10: mod_base = OTHER; note = 2'-deoxy-2'-fluorocytidine-3'-phosphate
  modified_base 11: mod_base = OTHER; note = 2'-deoxy-2'-fluorouridine-3'-phosphate
  modified_base 12: mod_base = OTHER; note = 2'-O-methylcytidine-3'-phosphate
  modified_base 13: mod_base = OTHER; note = 2'-deoxy-2'-fluoroadenosine-3'-phosphate
  modified_base 14: mod_base = OTHER; note = 2'-O-methyladenosine-3'-phosphate
  modified_base 15: mod_base = OTHER; note = 2'-deoxy-2'-fluoroguanosine-3'-phosphate
  modified_base 16: mod_base = OTHER; note = 2'-O-methyluridine-3'-phosphate
  modified_base 17: mod_base = OTHER; note = 2'-deoxy-2'-fluorocytidine-3'-phosphate
  modified_base 18: mod_base = OTHER; note = 2'-O-methyluridine-3'-phosphate
  modified_base 19: mod_base = OTHER; note = 2'-deoxy-2'-fluorouridine-3'-phosphate
  modified_base 20: mod_base = OTHER; note = 2'-O-methyladenosine-3'-phosphate
  modified_base 21: mod_base = OTHER; note = 2'-deoxy-2'-fluoroadenosine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
caggatcatctcaagtcttaa

SEQ ID NO: 251 - RNA, 21 nt, synthetic construct
  source 1..21: mol_type = other RNA
  modified_base 1: mod_base = OTHER; note = 2'-deoxy-2'-fluorocytidine-3'-phosphorothioate
  modified_base 2: mod_base = OTHER; note = 2'-O-methyladenosine-3'-phosphorothioate
  modified_base 3: mod_base = OTHER; note = 2'-deoxy-2'-fluoroguanosine-3'-phosphate
  modified_base 4: mod_base = OTHER; note = 2'-O-methylguanosine-3'-phosphate
  modified_base 5: mod_base = OTHER; note = 2'-deoxy-2'-fluoroadenosine-3'-phosphate
  modified_base 6: mod_base = OTHER; note = 2'-O-methyluridine-3'-phosphate
  modified_base 7: mod_base = OTHER; note = 2'-deoxy-2'-fluorocytidine-3'-phosphate
  modified_base 8: mod_base = OTHER; note = 2'-O-methyladenosine-3'-phosphate
  modified_base 9: mod_base = OTHER; note = 2'-deoxy-2'-fluorouridine-3'-phosphate
  modified_base 10: mod_base = OTHER; note = 2'-deoxy-2'-fluorocytidine-3'-phosphate
  modified_base 11: mod_base = OTHER; note = 2'-deoxy-2'-fluorouridine-3'-phosphate
  modified_base 12: mod_base = OTHER; note = 2'-O-methylcytidine-3'-phosphate
  modified_base 13: mod_base = OTHER; note = 2'-deoxy-2'-fluoroadenosine-3'-phosphate
  modified_base 14: mod_base = OTHER; note = 2'-O-methyladenosine-3'-phosphate
  modified_base 15: mod_base = OTHER; note = 2'-deoxy-2'-fluoroguanosine-3'-phosphate
  modified_base 16: mod_base = OTHER; note = 2'-O-methyluridine-3'-phosphate
  modified_base 17: mod_base = OTHER; note = 2'-deoxy-2'-fluorocytidine-3'-phosphate
  modified_base 18: mod_base = OTHER; note = 2'-O-methyluridine-3'-phosphate
  modified_base 19: mod_base = OTHER; note = 2'-deoxy-2'-fluorouridine-3'-phosphate
  modified_base 20: mod_base = OTHER; note = 2'-O-methyladenosine-3'-phosphate
  modified_base 21: mod_base = OTHER; note = 2'-deoxy-2'-fluoroadenosine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
caggatcatctcaagtcttaa

SEQ ID NO: 252 - RNA, 21 nt, synthetic construct
  source 1..21: mol_type = other RNA
  modified_base 1: mod_base = OTHER; note = 2'-deoxy-2'-fluorocytidine-3'-phosphorothioate
  modified_base 2: mod_base = OTHER; note = 2'-O-methyladenosine-3'-phosphorothioate
  modified_base 3: mod_base = OTHER; note = 2'-deoxy-2'-fluoroguanosine-3'-phosphate
  modified_base 4: mod_base = OTHER; note = 2'-O-methylguanosine-3'-phosphate
  modified_base 5: mod_base = OTHER; note = 2'-deoxy-2'-fluoroadenosine-3'-phosphate
  modified_base 6: mod_base = OTHER; note = 2'-O-methyluridine-3'-phosphate
  modified_base 7: mod_base = OTHER; note = 2'-deoxy-2'-fluorocytidine-3'-phosphate
  modified_base 8: mod_base = OTHER; note = 2'-O-methyladenosine-3'-phosphate
  modified_base 9: mod_base = OTHER; note = 2'-deoxy-2'-fluorouridine-3'-phosphate
  modified_base 10: mod_base = OTHER; note = 2'-deoxy-2'-fluorocytidine-3'-phosphate
  modified_base 11: mod_base = OTHER; note = 2'-deoxy-2'-fluorouridine-3'-phosphate
  modified_base 12: mod_base = OTHER; note = 2'-O-methylcytidine-3'-phosphate
  modified_base 13: mod_base = OTHER; note = 2'-deoxy-2'-fluoroadenosine-3'-phosphate
  modified_base 14: mod_base = OTHER; note = 2'-O-methyladenosine-3'-phosphate
  modified_base 15: mod_base = OTHER; note = 2'-deoxy-2'-fluoroguanosine-3'-phosphate
  modified_base 16: mod_base = OTHER; note = 2'-O-methyluridine-3'-phosphate
  modified_base 17: mod_base = OTHER; note = 2'-deoxy-2'-fluorocytidine-3'-phosphate
  modified_base 18: mod_base = OTHER; note = 2'-O-methyluridine-3'-phosphate
  modified_base 19: mod_base = OTHER; note = 2'-deoxy-2'-fluorouridine-3'-phosphate
  modified_base 20: mod_base = OTHER; note = 2'-O-methyladenosine-3'-phosphate
  modified_base 21: mod_base = OTHER; note = 2'-deoxy-2'-fluoroadenosine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
caggatcatctcaagtcttaa

SEQ ID NO: 253 - RNA, 21 nt, synthetic construct
  source 1..21: mol_type = other RNA
  modified_base 1: mod_base = OTHER; note = 2'-deoxy-2'-fluorocytidine-3'-phosphorothioate
  modified_base 2: mod_base = OTHER; note = 2'-O-methyladenosine-3'-phosphorothioate
  modified_base 3: mod_base = OTHER; note = 2'-deoxy-2'-fluoroguanosine-3'-phosphate
  modified_base 4: mod_base = OTHER; note = 2'-O-methylguanosine-3'-phosphate
  modified_base 5: mod_base = OTHER; note = 2'-deoxy-2'-fluoroadenosine-3'-phosphate
  modified_base 6: mod_base = OTHER; note = 2'-O-methyluridine-3'-phosphate
  modified_base 7: mod_base = OTHER; note = 2'-deoxy-2'-fluorocytidine-3'-phosphate
  modified_base 8: mod_base = OTHER; note = 2'-O-methyladenosine-3'-phosphate
  modified_base 9: mod_base = OTHER; note = 2'-deoxy-2'-fluorouridine-3'-phosphate
  modified_base 10: mod_base = OTHER; note = 2'-deoxy-2'-fluorocytidine-3'-phosphate
  modified_base 11: mod_base = OTHER; note = 2'-deoxy-2'-fluorouridine-3'-phosphate
  modified_base 12: mod_base = OTHER; note = 2'-O-methylcytidine-3'-phosphate
  modified_base 13: mod_base = OTHER; note = 2'-deoxy-2'-fluoroadenosine-3'-phosphate
  modified_base 14: mod_base = OTHER; note = 2'-O-methyladenosine-3'-phosphate
  modified_base 15: mod_base = OTHER; note = 2'-deoxy-2'-fluoroguanosine-3'-phosphate
  modified_base 16: mod_base = OTHER; note = 2'-O-methyluridine-3'-phosphate
  modified_base 17: mod_base = OTHER; note = 2'-deoxy-2'-fluorocytidine-3'-phosphate
  modified_base 18: mod_base = OTHER; note = 2'-O-methyluridine-3'-phosphate
  modified_base 19: mod_base = OTHER; note = 2'-deoxy-2'-fluorouridine-3'-phosphate
  modified_base 20: mod_base = OTHER; note = 2'-O-methyladenosine-3'-phosphate
  modified_base 21: mod_base = OTHER; note = 2'-deoxy-2'-fluoroadenosine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
caggatcatctcaagtcttaa

SEQ ID NO: 254 - RNA, 23 nt, synthetic construct
  source 1..23: mol_type = other RNA
  modified_base 1: mod_base = OTHER; note = 2'-O-methylguanosine-3'-phosphorothioate
  modified_base 2: mod_base = OTHER; note = 2'-deoxy-2'-fluorouridine-3'-phosphorothioate
  modified_base 3: mod_base = OTHER; note = 2'-O-methyladenosine-3'-phosphate
  modified_base 4: mod_base = OTHER; note = 2'-deoxy-2'-fluoroadenosine-3'-phosphate
  modified_base 5: mod_base = OTHER; note = 2'-O-methylguanosine-3'-phosphate
  modified_base 6: mod_base = OTHER; note = 2'-deoxy-2'-fluoroadenosine-3'-phosphate
  modified_base 7: mod_base = OTHER; note = 2'-O-methylcytidine-3'-phosphate
  modified_base 8: mod_base = OTHER; note = 2'-deoxy-2'-fluorouridine-3'-phosphate
  modified_base 9: mod_base = OTHER; note = 2'-O-methyluridine-3'-phosphate
  modified_base 10: mod_base = OTHER; note = 2'-deoxy-2'-fluoroguanosine-3'-phosphate
  modified_base 11: mod_base = OTHER; note = 2'-O-methyladenosine-3'-phosphate
  modified_base 12: mod_base = OTHER; note = 2'-O-methylguanosine-3'-phosphate
  modified_base 13: mod_base = OTHER; note = 2'-O-methyladenosine-3'-phosphate
  modified_base 14: mod_base = OTHER; note = 2'-deoxy-2'-fluorouridine-3'-phosphate
  modified_base 15: mod_base = OTHER; note = 2'-O-methylguanosine-3'-phosphate
  modified_base 16: mod_base = OTHER; note = 2'-deoxy-2'-fluoroadenosine-3'-phosphate
  modified_base 17: mod_base = OTHER; note = 2'-O-methyluridine-3'-phosphate
  modified_base 18: mod_base = OTHER; note = 2'-deoxy-2'-fluorocytidine-3'-phosphate
  modified_base 19: mod_base = OTHER; note = 2'-O-methylcytidine-3'-phosphate
  modified_base 20: mod_base = OTHER; note = 2'-deoxy-2'-fluorouridine-3'-phosphate
  modified_base 21: mod_base = OTHER; note = 2'-O-methylguanosine-3'-phosphorothioate
  modified_base 22: mod_base = OTHER; note = 2'-O-methylguanosine-3'-phosphorothioate
  modified_base 23: mod_base = OTHER; note = 2'-O-methylcytidine
gtaagacttgagatgatcctggc

SEQ ID NO: 255 - RNA, 23 nt, synthetic construct
  source 1..23: mol_type = other RNA
  modified_base 1: mod_base = OTHER; note = 2'-O-methyluridine-3'-phosphorothioate
  modified_base 2: mod_base = OTHER; note = 2'-deoxy-2'-fluorouridine-3'-phosphorothioate
  modified_base 3: mod_base = OTHER; note = 2'-O-methyladenosine-3'-phosphate
  modified_base 4: mod_base = OTHER; note = 2'-deoxy-2'-fluoroadenosine-3'-phosphate
  modified_base 5: mod_base = OTHER; note = 2'-O-methylguanosine-3'-phosphate
  modified_base 6: mod_base = OTHER; note = 2'-deoxy-2'-fluoroadenosine-3'-phosphate
  modified_base 7: mod_base = OTHER; note = 2'-O-methylcytidine-3'-phosphate
  modified_base 8: mod_base = OTHER; note = 2'-deoxy-2'-fluorouridine-3'-phosphate
  modified_base 9: mod_base = OTHER; note = 2'-O-methyluridine-3'-phosphate
  modified_base 10: mod_base = OTHER; note = 2'-deoxy-2'-fluoroguanosine-3'-phosphate
  modified_base 11: mod_base = OTHER; note = 2'-O-methyladenosine-3'-phosphate
  modified_base 12: mod_base = OTHER; note = 2'-O-methylguanosine-3'-phosphate
  modified_base 13: mod_base = OTHER; note = 2'-O-methyladenosine-3'-phosphate
  modified_base 14: mod_base = OTHER; note = 2'-deoxy-2'-fluorouridine-3'-phosphate
  modified_base 15: mod_base = OTHER; note = 2'-O-methylguanosine-3'-phosphate
  modified_base 16: mod_base = OTHER; note = 2'-deoxy-2'-fluoroadenosine-3'-phosphate
  modified_base 17: mod_base = OTHER; note = 2'-O-methyluridine-3'-phosphate
  modified_base 18: mod_base = OTHER; note = 2'-deoxy-2'-fluorocytidine-3'-phosphate
  modified_base 19: mod_base = OTHER; note = 2'-O-methylcytidine-3'-phosphate
  modified_base 20: mod_base = OTHER; note = 2'-deoxy-2'-fluorouridine-3'-phosphate
  modified_base 21: mod_base = OTHER; note = 2'-O-methylguanosine-3'-phosphorothioate
  modified_base 22: mod_base = OTHER; note = 2'-O-methylguanosine-3'-phosphorothioate
  modified_base 23: mod_base = OTHER; note = 2'-O-methylcytidine
ttaagacttgagatgatcctggc

SEQ ID NO: 256 - RNA, 23 nt, synthetic construct
  source 1..23: mol_type = other RNA
  modified_base 1: mod_base = OTHER; note = 2'-O-methyluridine-3'-phosphorothioate
  modified_base 2: mod_base = OTHER; note = 2'-deoxy-2'-fluorouridine-3'-phosphorothioate
  modified_base 3: mod_base = OTHER; note = 2'-O-methyladenosine-3'-phosphate
  modified_base 4: mod_base = OTHER; note = 2'-deoxy-2'-fluoroadenosine-3'-phosphate
  modified_base 5: mod_base = OTHER; note = 2'-O-methylguanosine-3'-phosphate
  modified_base 6: mod_base = OTHER; note = 2'-deoxy-2'-fluoroadenosine-3'-phosphate
  modified_base 7: mod_base = OTHER; note = 2'-O-methylcytidine-3'-phosphate
  modified_base 8: mod_base = OTHER; note = 2'-deoxy-2'-fluorouridine-3'-phosphate
  modified_base 9: mod_base = OTHER; note = 2'-O-methyluridine-3'-phosphate
  modified_base 10: mod_base = OTHER; note = 2'-deoxy-2'-fluoroguanosine-3'-phosphate
  modified_base 11: mod_base = OTHER; note = 2'-O-methyladenosine-3'-phosphate
  modified_base 12: mod_base = OTHER; note = 2'-O-methylguanosine-3'-phosphate
  modified_base 13: mod_base = OTHER; note = 2'-O-methyladenosine-3'-phosphate
  modified_base 14: mod_base = OTHER; note = 2'-deoxy-2'-fluorouridine-3'-phosphate
  modified_base 15: mod_base = OTHER; note = 2'-O-methylguanosine-3'-phosphate
  modified_base 16: mod_base = OTHER; note = 2'-deoxy-2'-fluoroadenosine-3'-phosphate
  modified_base 17: mod_base = OTHER; note = 2'-O-methyluridine-3'-phosphate
  modified_base 18: mod_base = OTHER; note = 2'-deoxy-2'-fluorocytidine-3'-phosphate
  modified_base 19: mod_base = OTHER; note = 2'-O-methylcytidine-3'-phosphate
  modified_base 20: mod_base = OTHER; note = 2'-deoxy-2'-fluorouridine-3'-phosphate
  modified_base 21: mod_base = OTHER; note = 2'-O-methylguanosine-3'-phosphorothioate
  modified_base 22: mod_base = OTHER; note = 2'-O-methylguanosine-3'-phosphorothioate
  modified_base 23: mod_base = OTHER; note = 2'-O-methylcytidine
ttaagacttgagatgatcctggc

SEQ ID NO: 257 - RNA, 23 nt, synthetic construct
  source 1..23: mol_type = other RNA
  modified_base 1: mod_base = OTHER; note = 2'-O-methyluridine-3'-phosphorothioate
  modified_base 2: mod_base = OTHER; note = 2'-deoxy-2'-fluorouridine-3'-phosphorothioate
  modified_base 3: mod_base = OTHER; note = 2'-O-methyladenosine-3'-phosphate
  modified_base 4: mod_base = OTHER; note = 2'-deoxy-2'-fluoroadenosine-3'-phosphate
  modified_base 5: mod_base = OTHER; note = 2'-O-methylguanosine-3'-phosphate
  modified_base 6: mod_base = OTHER; note = 2'-deoxy-2'-fluoroadenosine-3'-phosphate
  modified_base 7: mod_base = OTHER; note = 2'-O-methylcytidine-3'-phosphate
  modified_base 8: mod_base = OTHER; note = 2'-deoxy-2'-fluorouridine-3'-phosphate
  modified_base 9: mod_base = OTHER; note = 2'-O-methyluridine-3'-phosphate
  modified_base 10: mod_base = OTHER; note = 2'-deoxy-2'-fluoroguanosine-3'-phosphate
  modified_base 11: mod_base = OTHER; note = 2'-O-methyladenosine-3'-phosphate
  modified_base 12: mod_base = OTHER; note = 2'-O-methylguanosine-3'-phosphate
  modified_base 13: mod_base = OTHER; note = 2'-O-methyladenosine-3'-phosphate
  modified_base 14: mod_base = OTHER; note = 2'-deoxy-2'-fluorouridine-3'-phosphate
  modified_base 15: mod_base = OTHER; note = 2'-O-methylguanosine-3'-phosphate
  modified_base 16: mod_base = OTHER; note = 2'-deoxy-2'-fluoroadenosine-3'-phosphate
  modified_base 17: mod_base = OTHER; note = 2'-O-methyluridine-3'-phosphate
  modified_base 18: mod_base = OTHER; note = 2'-deoxy-2'-fluorocytidine-3'-phosphate
  modified_base 19: mod_base = OTHER; note = 2'-O-methylcytidine-3'-phosphate
  modified_base 20: mod_base = OTHER; note = 2'-deoxy-2'-fluorouridine-3'-phosphate
  modified_base 21: mod_base = OTHER; note = 2'-O-methylguanosine-3'-phosphorothioate
  modified_base 22: mod_base = OTHER; note = 2'-O-methylguanosine-3'-phosphorothioate
  modified_base 23: mod_base = OTHER; note = 2'-O-methylcytidine
ttaagacttgagatgatcctggc

SEQ ID NO: 258 - RNA, 23 nt, synthetic construct
  source 1..23: mol_type = other RNA
  modified_base 1: mod_base = OTHER; note = 2'-O-methyluridine-3'-phosphorothioate
  modified_base 2: mod_base = OTHER; note = 2'-deoxy-2'-fluorouridine-3'-phosphorothioate
  modified_base 3: mod_base = OTHER; note = 2'-O-methyladenosine-3'-phosphate
  modified_base 4: mod_base = OTHER; note = 2'-deoxy-2'-fluoroadenosine-3'-phosphate
  modified_base 5: mod_base = OTHER; note = 2'-O-methylguanosine-3'-phosphate
  modified_base 6: mod_base = OTHER; note = 2'-deoxy-2'-fluoroadenosine-3'-phosphate
  modified_base 7: mod_base = OTHER; note = 2'-O-methylcytidine-3'-phosphate
  modified_base 8: mod_base = OTHER; note = 2'-deoxy-2'-fluorouridine-3'-phosphate
  modified_base 9: mod_base = OTHER; note = 2'-O-methyluridine-3'-phosphate
  modified_base 10: mod_base = OTHER; note = 2'-deoxy-2'-fluoroguanosine-3'-phosphate
  modified_base 11: mod_base = OTHER; note = 2'-O-methyladenosine-3'-phosphate
  modified_base 12: mod_base = OTHER; note = 2'-O-methylguanosine-3'-phosphate
  modified_base 13: mod_base = OTHER; note = 2'-O-methyladenosine-3'-phosphate
  modified_base 14: mod_base = OTHER; note = 2'-deoxy-2'-fluorouridine-3'-phosphate
  modified_base 15: mod_base = OTHER; note = 2'-O-methylguanosine-3'-phosphate
  modified_base 16: mod_base = OTHER; note = 2'-deoxy-2'-fluoroadenosine-3'-phosphate
  modified_base 17: mod_base = OTHER; note = 2'-O-methyluridine-3'-phosphate
  modified_base 18: mod_base = OTHER; note = 2'-deoxy-2'-fluorocytidine-3'-phosphate
  modified_base 19: mod_base = OTHER; note = 2'-O-methylcytidine-3'-phosphate
  modified_base 20: mod_base = OTHER; note = 2'-deoxy-2'-fluorouridine-3'-phosphate
  modified_base 21: mod_base = OTHER; note = 2'-O-methylguanosine-3'-phosphorothioate
  modified_base 22: mod_base = OTHER; note = 2'-O-methylguanosine-3'-phosphorothioate
  modified_base 23: mod_base = OTHER; note = 2'-O-methylcytidine
ttaagacttgagatgatcctggc

SEQ ID NO: 259 - RNA, 23 nt, synthetic construct
  source 1..23: mol_type = other RNA
  modified_base 1: mod_base = OTHER; note = 2'-O-methyluridine-3'-phosphorothioate
  modified_base 2: mod_base = OTHER; note = 2'-deoxy-2'-fluorouridine-3'-phosphorothioate
  modified_base 3: mod_base = OTHER; note = 2'-O-methyladenosine-3'-phosphate
  modified_base 4: mod_base = OTHER; note = 2'-deoxy-2'-fluoroadenosine-3'-phosphate
  modified_base 5: mod_base = OTHER; note = 2'-O-methylguanosine-3'-phosphate
  modified_base 6: mod_base = OTHER; note = 2'-deoxy-2'-fluoroadenosine-3'-phosphate
  modified_base 7: mod_base = OTHER; note = 2'-O-methylcytidine-3'-phosphate
  modified_base 8: mod_base = OTHER; note = 2'-deoxy-2'-fluorouridine-3'-phosphate
  modified_base 9: mod_base = OTHER; note = 2'-O-methyluridine-3'-phosphate
  modified_base 10: mod_base = OTHER; note = 2'-deoxy-2'-fluoroguanosine-3'-phosphate
  modified_base 11: mod_base = OTHER; note = 2'-O-methyladenosine-3'-phosphate
  modified_base 12: mod_base = OTHER; note = 2'-O-methylguanosine-3'-phosphate
  modified_base 13: mod_base = OTHER; note = 2'-O-methyladenosine-3'-phosphate
  modified_base 14: mod_base = OTHER; note = 2'-deoxy-2'-fluorouridine-3'-phosphate
  modified_base 15: mod_base = OTHER; note = 2'-O-methylguanosine-3'-phosphate
  modified_base 16: mod_base = OTHER; note = 2'-deoxy-2'-fluoroadenosine-3'-phosphate
  modified_base 17: mod_base = OTHER; note = 2'-O-methyluridine-3'-phosphate
  modified_base 18: mod_base = OTHER; note = 2'-deoxy-2'-fluorocytidine-3'-phosphate
  modified_base 19: mod_base = OTHER; note = 2'-O-methylcytidine-3'-phosphate
  modified_base 20: mod_base = OTHER; note = 2'-deoxy-2'-fluorouridine-3'-phosphate
  modified_base 21: mod_base = OTHER; note = 2'-O-methylguanosine-3'-phosphorothioate
  modified_base 22: mod_base = OTHER; note = 2'-O-methylguanosine-3'-phosphorothioate
  modified_base 23: mod_base = OTHER; note = 2'-O-methylcytidine
ttaagacttgagatgatcctggc

SEQ ID NO: 260 - RNA, 23 nt, synthetic construct
  source 1..23: mol_type = other RNA
  modified_base 1: mod_base = OTHER; note = 2'-O-methyluridine-3'-phosphorothioate
  modified_base 2: mod_base = OTHER; note = 2'-deoxy-2'-fluorouridine-3'-phosphorothioate
  modified_base 3: mod_base = OTHER; note = 2'-O-methyladenosine-3'-phosphate
  modified_base 4: mod_base = OTHER; note = 2'-deoxy-2'-fluoroadenosine-3'-phosphate
  modified_base 5: mod_base = OTHER; note = 2'-O-methylguanosine-3'-phosphate
  modified_base 6: mod_base = OTHER; note = 2'-deoxy-2'-fluoroadenosine-3'-phosphate
  modified_base 7: mod_base = OTHER; note = 2'-O-methylcytidine-3'-phosphate
  modified_base 8: mod_base = OTHER; note = 2'-deoxy-2'-fluorouridine-3'-phosphate
  modified_base 9: mod_base = OTHER; note = 2'-O-methyluridine-3'-phosphate
  modified_base 10: mod_base = OTHER; note = 2'-deoxy-2'-fluoroguanosine-3'-phosphate
  modified_base 11: mod_base = OTHER; note = 2'-O-methyladenosine-3'-phosphate
  modified_base 12: mod_base = OTHER; note = 2'-O-methylguanosine-3'-phosphate
  modified_base 13: mod_base = OTHER; note = 2'-O-methyladenosine-3'-phosphate
  modified_base 14: mod_base = OTHER; note = 2'-deoxy-2'-fluorouridine-3'-phosphate
  modified_base 15: mod_base = OTHER; note = 2'-O-methylguanosine-3'-phosphate
  modified_base 16: mod_base = OTHER; note = 2'-deoxy-2'-fluoroadenosine-3'-phosphate
  modified_base 17: mod_base = OTHER; note = 2'-O-methyluridine-3'-phosphate
  modified_base 18: mod_base = OTHER; note = 2'-deoxy-2'-fluorocytidine-3'-phosphate
  modified_base 19: mod_base = OTHER; note = 2'-O-methylcytidine-3'-phosphate
  modified_base 20: mod_base = OTHER; note = 2'-deoxy-2'-fluorouridine-3'-phosphate
  modified_base 21: mod_base = OTHER; note = 2'-O-methylguanosine-3'-phosphorothioate
  modified_base 22: mod_base = OTHER; note = 2'-O-methylguanosine-3'-phosphorothioate
  modified_base 23: mod_base = OTHER; note = 2'-O-methylcytidine
ttaagacttgagatgatcctggc

SEQ ID NO: 261 - RNA, 23 nt, synthetic construct
  source 1..23: mol_type = other RNA
  modified_base 1: mod_base = OTHER; note = 2'-O-methyluridine-3'-phosphorothioate
  modified_base 2: mod_base = OTHER; note = 2'-deoxy-2'-fluorouridine-3'-phosphorothioate
  modified_base 3: mod_base = OTHER; note = 2'-O-methyladenosine-3'-phosphate
  modified_base 4: mod_base = OTHER; note = 2'-deoxy-2'-fluoroadenosine-3'-phosphate
  modified_base 5: mod_base = OTHER; note = 2'-O-methylguanosine-3'-phosphate
  modified_base 6: mod_base = OTHER; note = 2'-deoxy-2'-fluoroadenosine-3'-phosphate
  modified_base 7: mod_base = OTHER; note = 2'-O-methylcytidine-3'-phosphate
  modified_base 8: mod_base = OTHER; note = 2'-deoxy-2'-fluorouridine-3'-phosphate
  modified_base 9: mod_base = OTHER; note = 2'-O-methyluridine-3'-phosphate
  modified_base 10: mod_base = OTHER; note = 2'-deoxy-2'-fluoroguanosine-3'-phosphate
  modified_base 11: mod_base = OTHER; note = 2'-O-methyladenosine-3'-phosphate
  modified_base 12: mod_base = OTHER; note = 2'-O-methylguanosine-3'-phosphate
  modified_base 13: mod_base = OTHER; note = 2'-O-methyladenosine-3'-phosphate
  modified_base 14: mod_base = OTHER; note = 2'-deoxy-2'-fluorouridine-3'-phosphate
  modified_base 15: mod_base = OTHER; note = 2'-O-methylguanosine-3'-phosphate
  modified_base 16: mod_base = OTHER; note = 2'-deoxy-2'-fluoroadenosine-3'-phosphate
  modified_base 17: mod_base = OTHER; note = 2'-O-methyluridine-3'-phosphate
  modified_base 18: mod_base = OTHER; note = 2'-deoxy-2'-fluorocytidine-3'-phosphate
  modified_base 19: mod_base = OTHER; note = 2'-O-methylcytidine-3'-phosphate
  modified_base 20: mod_base = OTHER; note = 2'-deoxy-2'-fluorouridine-3'-phosphate
  modified_base 21: mod_base = OTHER; note = 2'-O-methylguanosine-3'-phosphorothioate
  modified_base 22: mod_base = OTHER; note = 2'-O-methylguanosine-3'-phosphorothioate
  modified_base 23: mod_base = OTHER; note = 2'-O-methylcytidine
ttaagacttgagatgatcctggc

SEQ ID NO: 262 - RNA, 23 nt, synthetic construct
  source 1..23: mol_type = other RNA
  modified_base 1: mod_base = OTHER; note = 2'-O-methyluridine-3'-phosphorothioate
  modified_base 2: mod_base = OTHER; note = 2'-deoxy-2'-fluorouridine-3'-phosphorothioate
  modified_base 3: mod_base = OTHER; note = 2'-O-methyladenosine-3'-phosphate
  modified_base 4: mod_base = OTHER; note = 2'-deoxy-2'-fluoroadenosine-3'-phosphate
  modified_base 5: mod_base = OTHER; note = 2'-O-methylguanosine-3'-phosphate
  modified_base 6: mod_base = OTHER; note = 2'-deoxy-2'-fluoroadenosine-3'-phosphate
  modified_base 7: mod_base = OTHER; note = 2'-O-methylcytidine-3'-phosphate
  modified_base 8: mod_base = OTHER; note = 2'-deoxy-2'-fluorouridine-3'-phosphate
  modified_base 9: mod_base = OTHER; note = 2'-O-methyluridine-3'-phosphate
  modified_base 10: mod_base = OTHER; note = 2'-deoxy-2'-fluoroguanosine-3'-phosphate
  modified_base 11: mod_base = OTHER; note = 2'-O-methyladenosine-3'-phosphate
  modified_base 12: mod_base = OTHER; note = 2'-O-methylguanosine-3'-phosphate
  modified_base 13: mod_base = OTHER; note = 2'-O-methyladenosine-3'-phosphate
  modified_base 14: mod_base = OTHER; note = 2'-deoxy-2'-fluorouridine-3'-phosphate
  modified_base 15: mod_base = OTHER; note = 2'-O-methylguanosine-3'-phosphate
  modified_base 16: mod_base = OTHER; note = 2'-deoxy-2'-fluoroadenosine-3'-phosphate
  modified_base 17: mod_base = OTHER; note = 2'-O-methyluridine-3'-phosphate
  modified_base 18: mod_base = OTHER; note = 2'-deoxy-2'-fluorocytidine-3'-phosphate
  modified_base 19: mod_base = OTHER; note = 2'-O-methylcytidine-3'-phosphate
  modified_base 20: mod_base = OTHER; note = 2'-deoxy-2'-fluorouridine-3'-phosphate
  modified_base 21: mod_base = OTHER; note = 2'-O-methylguanosine-3'-phosphorothioate
  modified_base 22: mod_base = OTHER; note = 2'-O-methylguanosine-3'-phosphorothioate
  modified_base 23: mod_base = OTHER; note = 2'-O-methylcytidine
ttaagacttgagatgatcctggc

SEQ ID NO: 263 - RNA, 23 nt, synthetic construct
  source 1..23: mol_type = other RNA
  modified_base 1: mod_base = OTHER; note = 2'-O-methyluridine-3'-phosphorothioate
  modified_base 2: mod_base = OTHER; note = 2'-deoxy-2'-fluorouridine-3'-phosphorothioate
  modified_base 3: mod_base = OTHER; note = 2'-O-methyladenosine-3'-phosphate
  modified_base 4: mod_base = OTHER; note = 2'-deoxy-2'-fluoroadenosine-3'-phosphate
  modified_base 5: mod_base = OTHER; note = 2'-O-methylguanosine-3'-phosphate
  modified_base 6: mod_base = OTHER; note = 2'-deoxy-2'-fluoroadenosine-3'-phosphate
  modified_base 7: mod_base = OTHER; note = 2'-O-methylcytidine-3'-phosphate
  modified_base 8: mod_base = OTHER; note = 2'-deoxy-2'-fluorouridine-3'-phosphate
  modified_base 9: mod_base = OTHER; note = 2'-O-methyluridine-3'-phosphate
  modified_base 10: mod_base = OTHER; note = 2'-deoxy-2'-fluoroguanosine-3'-phosphate
  modified_base 11: mod_base = OTHER; note = 2'-O-methyladenosine-3'-phosphate
  modified_base 12: mod_base = OTHER; note = 2'-O-methylguanosine-3'-phosphate
  modified_base 13: mod_base = OTHER; note = 2'-O-methyladenosine-3'-phosphate
  modified_base 14: mod_base = OTHER; note = 2'-deoxy-2'-fluorouridine-3'-phosphate
  modified_base 15: mod_base = OTHER; note = 2'-O-methylguanosine-3'-phosphate
  modified_base 16: mod_base = OTHER; note = 2'-deoxy-2'-fluoroadenosine-3'-phosphate
  modified_base 17: mod_base = OTHER; note = 2'-O-methyluridine-3'-phosphate
  modified_base 18: mod_base = OTHER; note = 2'-deoxy-2'-fluorocytidine-3'-phosphate
  modified_base 19: mod_base = OTHER; note = 2'-O-methylcytidine-3'-phosphate
  modified_base 20: mod_base = OTHER; note = 2'-deoxy-2'-fluorouridine-3'-phosphate
  modified_base 21: mod_base = OTHER; note = 2'-O-methylguanosine-3'-phosphorothioate
  modified_base 22: mod_base = OTHER; note = 2'-O-methylguanosine-3'-phosphorothioate
  modified_base 23: mod_base = OTHER; note = 2'-O-methylcytidine
ttaagacttgagatgatcctggc

SEQ ID NO: 264 - RNA, 23 nt, synthetic construct
  source 1..23: mol_type = other RNA
  modified_base 1: mod_base = OTHER; note = 2'-O-methyluridine-3'-phosphorothioate
  modified_base 2: mod_base = OTHER; note = 2'-deoxy-2'-fluorouridine-3'-phosphorothioate
  modified_base 3: mod_base = OTHER; note = 2'-O-methyladenosine-3'-phosphate
  modified_base 4: mod_base = OTHER; note = 2'-deoxy-2'-fluoroadenosine-3'-phosphate
  modified_base 5: mod_base = OTHER; note = 2'-O-methylguanosine-3'-phosphate
  modified_base 6: mod_base = OTHER; note = 2'-deoxy-2'-fluoroadenosine-3'-phosphate
  modified_base 7: mod_base = OTHER; note = 2'-O-methylcytidine-3'-phosphate
  modified_base 8: mod_base = OTHER; note = 2'-deoxy-2'-fluorouridine-3'-phosphate
  modified_base 9: mod_base = OTHER; note = 2'-O-methyluridine-3'-phosphate
  modified_base 10: mod_base = OTHER; note = 2'-deoxy-2'-fluoroguanosine-3'-phosphate
  modified_base 11: mod_base = OTHER; note = 2'-O-methyladenosine-3'-phosphate
  modified_base 12: mod_base = OTHER; note = 2'-O-methylguanosine-3'-phosphate
  modified_base 13: mod_base = OTHER; note = 2'-O-methyladenosine-3'-phosphate
  modified_base 14: mod_base = OTHER; note = 2'-deoxy-2'-fluorouridine-3'-phosphate
  modified_base 15: mod_base = OTHER; note = 2'-O-methylguanosine-3'-phosphate
  modified_base 16: mod_base = OTHER; note = 2'-deoxy-2'-fluoroadenosine-3'-phosphate
  modified_base 17: mod_base = OTHER; note = 2'-O-methyluridine-3'-phosphate
  modified_base 18: mod_base = OTHER; note = 2'-deoxy-2'-fluorocytidine-3'-phosphate
  modified_base 19: mod_base = OTHER; note = 2'-O-methylcytidine-3'-phosphate
  modified_base 20: mod_base = OTHER; note = 2'-deoxy-2'-fluorouridine-3'-phosphate
  modified_base 21: mod_base = OTHER; note = 2'-O-methylguanosine-3'-phosphorothioate
  modified_base 22: mod_base = OTHER; note = 2'-O-methylguanosine-3'-phosphorothioate
  modified_base 23: mod_base = OTHER; note = 2'-O-methylcytidine
ttaagacttgagatgatcctggc

SEQ ID NO: 265 - RNA, 23 nt, synthetic construct
  source 1..23: mol_type = other RNA
  modified_base 1: mod_base = OTHER; note = 2'-O-methyluridine-3'-phosphorothioate
  modified_base 2: mod_base = OTHER; note = 2'-deoxy-2'-fluorouridine-3'-phosphorothioate
  modified_base 3: mod_base = OTHER; note = 2'-O-methyladenosine-3'-phosphate
  modified_base 4: mod_base = OTHER; note = 2'-deoxy-2'-fluoroadenosine-3'-phosphate
  modified_base 5: mod_base = OTHER; note = 2'-O-methylguanosine-3'-phosphate
  modified_base 6: mod_base = OTHER; note = 2'-deoxy-2'-fluoroadenosine-3'-phosphate
  modified_base 7: mod_base = OTHER; note = 2'-O-methylcytidine-3'-phosphate
  modified_base 8: mod_base = OTHER; note = 2'-deoxy-2'-fluorouridine-3'-phosphate
  modified_base 9: mod_base = OTHER; note = 2'-O-methyluridine-3'-phosphate
  modified_base 10: mod_base = OTHER; note = 2'-deoxy-2'-fluoroguanosine-3'-phosphate
  modified_base 11: mod_base = OTHER; note = 2'-O-methyladenosine-3'-phosphate
  modified_base 12: mod_base = OTHER; note = 2'-O-methylguanosine-3'-phosphate
  modified_base 13: mod_base = OTHER; note = 2'-O-methyladenosine-3'-phosphate
  modified_base 14: mod_base = OTHER; note = 2'-deoxy-2'-fluorouridine-3'-phosphate
  modified_base 15: mod_base = OTHER; note = 2'-O-methylguanosine-3'-phosphate
  modified_base 16: mod_base = OTHER; note = 2'-deoxy-2'-fluoroadenosine-3'-phosphate
  modified_base 17: mod_base = OTHER; note = 2'-O-methyluridine-3'-phosphate
  modified_base 18: mod_base = OTHER; note = 2'-deoxy-2'-fluorocytidine-3'-phosphate
  modified_base 19: mod_base = OTHER; note = 2'-O-methylcytidine-3'-phosphate
  modified_base 20: mod_base = OTHER; note = 2'-deoxy-2'-fluorouridine-3'-phosphate
  modified_base 21: mod_base = OTHER; note = 2'-O-methylguanosine-3'-phosphorothioate
  modified_base 22: mod_base = OTHER; note = 2'-O-methylguanosine-3'-phosphorothioate
  modified_base 23: mod_base = OTHER; note = 2'-O-methylcytidine
ttaagacttgagatgatcctggc

SEQ ID NO: 266 - RNA, 23 nt, synthetic construct
  source 1..23: mol_type = other RNA
  modified_base 1: mod_base = OTHER; note = 2'-O-methyluridine-3'-phosphorothioate
  modified_base 2: mod_base = OTHER; note = 2'-deoxy-2'-fluorouridine-3'-phosphorothioate
  modified_base 3: mod_base = OTHER; note = 2'-O-methyladenosine-3'-phosphate
  modified_base 4: mod_base = OTHER; note = 2'-deoxy-2'-fluoroadenosine-3'-phosphate
  modified_base 5: mod_base = OTHER; note = 2'-O-methylguanosine-3'-phosphate
  modified_base 6: mod_base = OTHER; note = 2'-deoxy-2'-fluoroadenosine-3'-phosphate
  modified_base 7: mod_base = OTHER; note = 2'-O-methylcytidine-3'-phosphate
  modified_base 8: mod_base = OTHER; note = 2'-deoxy-2'-fluorouridine-3'-phosphate
  modified_base 9: mod_base = OTHER; note = 2'-O-methyluridine-3'-phosphate
  modified_base 10: mod_base = OTHER; note = 2'-deoxy-2'-fluoroguanosine-3'-phosphate
  modified_base 11: mod_base = OTHER; note = 2'-O-methyladenosine-3'-phosphate
  modified_base 12: mod_base = OTHER; note = 2'-O-methylguanosine-3'-phosphate
  modified_base 13: mod_base = OTHER; note = 2'-O-methyladenosine-3'-phosphate
  modified_base 14: mod_base = OTHER; note = 2'-deoxy-2'-fluorouridine-3'-phosphate
  modified_base 15: mod_base = OTHER; note = 2'-O-methylguanosine-3'-phosphate
  modified_base 16: mod_base = OTHER; note = 2'-deoxy-2'-fluoroadenosine-3'-phosphate
  modified_base 18: mod_base = OTHER; note = 2'-deoxy-2'-fluorocytidine-3'-phosphate
  modified_base 19: mod_base = OTHER; note = 2'-O-methylcytidine-3'-phosphate
  modified_base 20: mod_base = OTHER; note = 2'-deoxy-2'-fluorouridine-3'-phosphate
  modified_base 21: mod_base = OTHER; note = 2'-O-methylguanosine-3'-phosphorothioate
  modified_base 22: mod_base = OTHER; note = 2'-O-methylguanosine-3'-phosphorothioate
  modified_base 23: mod_base = OTHER; note = 2'-O-methylcytidine
ttaagacttgagatgatcctggc

SEQ ID NO: 267 - RNA, 23 nt, synthetic construct
  source 1..23: mol_type = other RNA
  modified_base 1: mod_base = OTHER; note = 2'-O-methyluridine-3'-phosphorothioate
  modified_base 2: mod_base = OTHER; note = 2'-deoxy-2'-fluorouridine-3'-phosphorothioate
  modified_base 3: mod_base = OTHER; note = 2'-O-methyladenosine-3'-phosphate
  modified_base 4: mod_base = OTHER; note = 2'-deoxy-2'-fluoroadenosine-3'-phosphate
  modified_base 5: mod_base = OTHER; note = 2'-O-methylguanosine-3'-phosphate
  modified_base 6: mod_base = OTHER; note = 2'-deoxy-2'-fluoroadenosine-3'-phosphate
  modified_base 7: mod_base = OTHER; note = 2'-O-methylcytidine-3'-phosphate
  modified_base 8: mod_base = OTHER; note = 2'-deoxy-2'-fluorouridine-3'-phosphate
  modified_base 9: mod_base = OTHER; note = 2'-O-methyluridine-3'-phosphate
  modified_base 10: mod_base = OTHER; note = 2'-deoxy-2'-fluoroguanosine-3'-phosphate
  modified_base 11: mod_base = OTHER; note = 2'-O-methyladenosine-3'-phosphate
  modified_base 12: mod_base = OTHER; note = 2'-O-methylguanosine-3'-phosphate
  modified_base 13: mod_base = OTHER; note = 2'-O-methyladenosine-3'-phosphate
  modified_base 14: mod_base = OTHER; note = 2'-deoxy-2'-fluorouridine-3'-phosphate
  modified_base 15: mod_base = OTHER; note = 2'-O-methylguanosine-3'-phosphate
  modified_base 16: mod_base = OTHER; note = 2'-deoxy-2'-fluoroadenosine-3'-phosphate
  modified_base 18: mod_base = OTHER; note = 2'-fluoro-5'-(S)-methyl-cytosine-3'-phosphate
  modified_base 19: mod_base = OTHER; note = 2'-O-methylcytidine-3'-phosphate
  modified_base 20: mod_base = OTHER; note = 2'-deoxy-2'-fluorouridine-3'-phosphate
  modified_base 21: mod_base = OTHER; note = 2'-O-methylguanosine-3'-phosphorothioate
  modified_base 22: mod_base = OTHER; note = 2'-O-methylguanosine-3'-phosphorothioate
  modified_base 23: mod_base = OTHER; note = 2'-O-methylcytidine
ttaagacttgagatgatcctggc

SEQ ID NO: 268 - RNA, 23 nt, synthetic construct
  source 1..23: mol_type = other RNA
  modified_base 1: mod_base = OTHER; note = 2'-O-methyluridine-3'-phosphorothioate
  modified_base 2: mod_base = OTHER; note = 2'-deoxy-2'-fluorouridine-3'-phosphorothioate
  modified_base 3: mod_base = OTHER; note = 2'-O-methyladenosine-3'-phosphate
  modified_base 4: mod_base = OTHER; note = 2'-deoxy-2'-fluoroadenosine-3'-phosphate
  modified_base 5: mod_base = OTHER; note = 2'-O-methylguanosine-3'-phosphate
  modified_base 6: mod_base = OTHER; note = 2'-deoxy-2'-fluoroadenosine-3'-phosphate
  modified_base 7: mod_base = OTHER; note = 2'-O-methylcytidine-3'-phosphate
  modified_base 8: mod_base = OTHER; note = 2'-deoxy-2'-fluorouridine-3'-phosphate
  modified_base 9: mod_base = OTHER; note = 2'-O-methyluridine-3'-phosphate
  modified_base 10: mod_base = OTHER; note = 2'-deoxy-2'-fluoroguanosine-3'-phosphate
  modified_base 11: mod_base = OTHER; note = 2'-O-methyladenosine-3'-phosphate
  modified_base 12: mod_base = OTHER; note = 2'-O-methylguanosine-3'-phosphate
  modified_base 13: mod_base = OTHER; note = 2'-O-methyladenosine-3'-phosphate
  modified_base 14: mod_base = OTHER; note = 2'-deoxy-2'-fluorouridine-3'-phosphate
  modified_base 15: mod_base = OTHER; note = 2'-O-methylguanosine-3'-phosphate
  modified_base 16: mod_base = OTHER; note = 2'-deoxy-2'-fluoroadenosine-3'-phosphate
  modified_base 18: mod_base = OTHER; note = 2'-fluoro-5'-(R)-methyl-cytosine-3'-phosphate
  modified_base 19: mod_base = OTHER; note = 2'-O-methylcytidine-3'-phosphate
  modified_base 20: mod_base = OTHER; note = 2'-deoxy-2'-fluorouridine-3'-phosphate
  modified_base 21: mod_base = OTHER; note = 2'-O-methylguanosine-3'-phosphorothioate
  modified_base 22: mod_base = OTHER; note = 2'-O-methylguanosine-3'-phosphorothioate
  modified_base 23: mod_base = OTHER; note = 2'-O-methylcytidine
ttaagacttgagatgatcctggc

SEQ ID NO: 269 - RNA, 23 nt, synthetic construct
  source 1..23: mol_type = other RNA
  modified_base 1: mod_base = OTHER; note = 2'-O-methyluridine-3'-phosphorothioate
  modified_base 2: mod_base = OTHER; note = 2'-deoxy-2'-fluorouridine-3'-phosphorothioate
  modified_base 3: mod_base = OTHER; note = 2'-O-methyladenosine-3'-phosphate
  modified_base 4: mod_base = OTHER; note = 2'-deoxy-2'-fluoroadenosine-3'-phosphate
  modified_base 5: mod_base = OTHER; note = 2'-O-methylguanosine-3'-phosphate
  modified_base 6: mod_base = OTHER; note = 2'-deoxy-2'-fluoroadenosine-3'-phosphate
  modified_base 7: mod_base = OTHER; note = 2'-O-methylcytidine-3'-phosphate
  modified_base 8: mod_base = OTHER; note = 2'-deoxy-2'-fluorouridine-3'-phosphate
  modified_base 9: mod_base = OTHER; note = 2'-O-methyluridine-3'-phosphate
  modified_base 10: mod_base = OTHER; note = 2'-deoxy-2'-fluoroguanosine-3'-phosphate
  modified_base 11: mod_base = OTHER; note = 2'-O-methyladenosine-3'-phosphate
  modified_base 12: mod_base = OTHER; note = 2'-O-methylguanosine-3'-phosphate
  modified_base 13: mod_base = OTHER; note = 2'-O-methyladenosine-3'-phosphate
  modified_base 14: mod_base = OTHER; note = 2'-deoxy-2'-fluorouridine-3'-phosphate
  modified_base 15: mod_base = OTHER; note = 2'-O-methylguanosine-3'-phosphate
  modified_base 16: mod_base = OTHER; note = 2'-deoxy-2'-fluoroadenosine-3'-phosphate
  modified_base 18: mod_base = OTHER; note = 2'-O-methyl-5'-(S)-methyl-cytidine-3'-phosphate
  modified_base 19: mod_base = OTHER; note = 2'-O-methylcytidine-3'-phosphate
  modified_base 20: mod_base = OTHER; note = 2'-deoxy-2'-fluorouridine-3'-phosphate
  modified_base 21: mod_base = OTHER; note = 2'-O-methylguanosine-3'-phosphorothioate
  modified_base 22: mod_base = OTHER; note = 2'-O-methylguanosine-3'-phosphorothioate
  modified_base 23: mod_base = OTHER; note = 2'-O-methylcytidine
ttaagacttgagatgatcctggc

SEQ ID NO: 270 - RNA, 23 nt, synthetic construct
  source 1..23: mol_type = other RNA
  modified_base 1: mod_base = OTHER; note = 2'-O-methyluridine-3'-phosphorothioate
  modified_base 2: mod_base = OTHER; note = 2'-deoxy-2'-fluorouridine-3'-phosphorothioate
  modified_base 3: mod_base = OTHER; note = 2'-O-methyladenosine-3'-phosphate
  modified_base 4: mod_base = OTHER; note = 2'-deoxy-2'-fluoroadenosine-3'-phosphate
  modified_base 5: mod_base = OTHER; note = 2'-O-methylguanosine-3'-phosphate
  modified_base 6: mod_base = OTHER; note = 2'-deoxy-2'-fluoroadenosine-3'-phosphate
  modified_base 7: mod_base = OTHER; note = 2'-O-methylcytidine-3'-phosphate
  modified_base 8: mod_base = OTHER; note = 2'-deoxy-2'-fluorouridine-3'-phosphate
  modified_base 9: mod_base = OTHER; note = 2'-O-methyluridine-3'-phosphate
  modified_base 10: mod_base = OTHER; note = 2'-deoxy-2'-fluoroguanosine-3'-phosphate
  modified_base 11: mod_base = OTHER; note = 2'-O-methyladenosine-3'-phosphate
  modified_base 12: mod_base = OTHER; note = 2'-O-methylguanosine-3'-phosphate
  modified_base 13: mod_base = OTHER; note = 2'-O-methyladenosine-3'-phosphate
  modified_base 14: mod_base = OTHER; note = 2'-deoxy-2'-fluorouridine-3'-phosphate
  modified_base 15: mod_base = OTHER; note = 2'-O-methylguanosine-3'-phosphate
  modified_base 16: mod_base = OTHER; note = 2'-deoxy-2'-fluoroadenosine-3'-phosphate
  modified_base 18: mod_base = OTHER; note = 2'-O-methyl-5'-(R)-methyl-cytidine-3'-phosphate
  modified_base 19: mod_base = OTHER; note = 2'-O-methylcytidine-3'-phosphate
  modified_base 20: mod_base = OTHER; note = 2'-deoxy-2'-fluorouridine-3'-phosphate
  modified_base 21: mod_base = OTHER; note = 2'-O-methylguanosine-3'-phosphorothioate
  modified_base 22: mod_base = OTHER; note = 2'-O-methylguanosine-3'-phosphorothioate
  modified_base 23: mod_base = OTHER; note = 2'-O-methylcytidine
ttaagacttgagatgatcctggc

SEQ ID NO: 271 - RNA, 23 nt, synthetic construct
  source 1..23: mol_type = other RNA
  modified_base 1: mod_base = OTHER; note = 2'-O-methyluridine-3'-phosphorothioate
  modified_base 2: mod_base = OTHER; note = 2'-deoxy-2'-fluorouridine-3'-phosphorothioate
  modified_base 3: mod_base = OTHER; note = 2'-O-methyladenosine-3'-phosphate
  modified_base 4: mod_base = OTHER; note = 2'-deoxy-2'-fluoroadenosine-3'-phosphate
  modified_base 5: mod_base = OTHER; note = 2'-O-methylguanosine-3'-phosphate
  modified_base 6: mod_base = OTHER; note = 2'-deoxy-2'-fluoroadenosine-3'-phosphate
  modified_base 7: mod_base = OTHER; note = 2'-O-methylcytidine-3'-phosphate
  modified_base 8: mod_base = OTHER; note = 2'-deoxy-2'-fluorouridine-3'-phosphate
  modified_base 9: mod_base = OTHER; note = 2'-O-methyluridine-3'-phosphate
  modified_base 10: mod_base = OTHER; note = 2'-deoxy-2'-fluoroguanosine-3'-phosphate
  modified_base 11: mod_base = OTHER; note = 2'-O-methyladenosine-3'-phosphate
  modified_base 12: mod_base = OTHER; note = 2'-O-methylguanosine-3'-phosphate
  modified_base 13: mod_base = OTHER; note = 2'-O-methyladenosine-3'-phosphate
  modified_base 14: mod_base = OTHER; note = 2'-deoxy-2'-fluorouridine-3'-phosphate
  modified_base 15: mod_base = OTHER; note = 2'-O-methylguanosine-3'-phosphate
  modified_base 16: mod_base = OTHER; note = 2'-deoxy-2'-fluoroadenosine-3'-phosphate
  modified_base 18: mod_base = OTHER; note = 2'-fluoro-4'-methoxycytidine-3'-phosphate
  modified_base 19: mod_base = OTHER; note = 2'-O-methylcytidine-3'-phosphate
  modified_base 20: mod_base = OTHER; note = 2'-deoxy-2'-fluorouridine-3'-phosphate
  modified_base 21: mod_base = OTHER; note = 2'-O-methylguanosine-3'-phosphorothioate
  modified_base 22: mod_base = OTHER; note = 2'-O-methylguanosine-3'-phosphorothioate
  modified_base 23: mod_base = OTHER; note = 2'-O-methylcytidine
ttaagacttgagatgatcctggc

SEQ ID NO: 272 - DNA, 23 bp, synthetic construct
  source 1..23: mol_type = other DNA
  modified_base 1: mod_base = OTHER; note = 2'-O-methyluridine-3'-phosphorothioate
  modified_base 2: mod_base = OTHER; note = 2'-deoxy-2'-fluorouridine-3'-phosphorothioate
  modified_base 3: mod_base = OTHER; note = 2'-O-methyladenosine-3'-phosphate
  modified_base 4: mod_base = OTHER; note = 2'-deoxy-2'-fluoroadenosine-3'-phosphate
  modified_base 5: mod_base = OTHER; note = 2'-O-methylguanosine-3'-phosphate
  modified_base 6: mod_base = OTHER; note = 2'-deoxy-2'-fluoroadenosine-3'-phosphate
  modified_base 7: mod_base = OTHER; note = 2'-O-methylcytidine-3'-phosphate
  modified_base 8: mod_base = OTHER; note = 2'-deoxy-2'-fluorouridine-3'-phosphate
  modified_base 9: mod_base = OTHER; note = 2'-O-methyluridine-3'-phosphate
  modified_base 10: mod_base = OTHER; note = 2'-deoxy-2'-fluoroguanosine-3'-phosphate
  modified_base 11: mod_base = OTHER; note = 2'-O-methyladenosine-3'-phosphate
  modified_base 12: mod_base = OTHER; note = 2'-O-methylguanosine-3'-phosphate
  modified_base 13: mod_base = OTHER; note = 2'-O-methyladenosine-3'-phosphate
  modified_base 14: mod_base = OTHER; note = 2'-deoxy-2'-fluorouridine-3'-phosphate
  modified_base 15: mod_base = OTHER; note = 2'-O-methylguanosine-3'-phosphate
  modified_base 16: mod_base = OTHER; note = 2'-deoxy-2'-fluoroadenosine-3'-phosphate
  modified_base 17: mod_base = OTHER; note = uridine-3'-phosphate
  modified_base 18: mod_base = OTHER; note = 4'-methoxy-2'-deoxycytidine-3'-phosphate
  modified_base 19: mod_base = OTHER; note = 2'-O-methylcytidine-3'-phosphate
  modified_base 20: mod_base = OTHER; note = 2'-deoxy-2'-fluorouridine-3'-phosphate
  modified_base 21: mod_base = OTHER; note = 2'-O-methylguanosine-3'-phosphorothioate
  modified_base 22: mod_base = OTHER; note = 2'-O-methylguanosine-3'-phosphorothioate
  modified_base 23: mod_base = OTHER; note = 2'-O-methylcytidine
  misc_feature 1..17: note = RNA
  misc_feature 19..23: note = RNA
  misc_feature 18: note = DNA
ttaagacttgagatgatcctggc

SEQ ID NO: 273 - RNA, 23 nt, synthetic construct
  source 1..23: mol_type = other RNA
  modified_base 1: mod_base = OTHER; note = 2'-O-methyluridine-3'-phosphorothioate
  modified_base 2: mod_base = OTHER; note = 2'-deoxy-2'-fluorouridine-3'-phosphorothioate
  modified_base 3: mod_base = OTHER; note = 2'-O-methyladenosine-3'-phosphate
  modified_base 4: mod_base = OTHER; note = 2'-deoxy-2'-fluoroadenosine-3'-phosphate
  modified_base 5: mod_base = OTHER; note = 2'-O-methylguanosine-3'-phosphate
  modified_base 6: mod_base = OTHER; note = 2'-deoxy-2'-fluoroadenosine-3'-phosphate
  modified_base 7: mod_base = OTHER; note = 2'-O-methylcytidine-3'-phosphate
  modified_base 8: mod_base = OTHER; note = 2'-deoxy-2'-fluorouridine-3'-phosphate
  modified_base 9: mod_base = OTHER; note = 2'-O-methyluridine-3'-phosphate
  modified_base 10: mod_base = OTHER; note = 2'-deoxy-2'-fluoroguanosine-3'-phosphate
  modified_base 11: mod_base = OTHER; note = 2'-O-methyladenosine-3'-phosphate
  modified_base 12: mod_base = OTHER; note = 2'-O-methylguanosine-3'-phosphate
  modified_base 13: mod_base = OTHER; note = 2'-O-methyladenosine-3'-phosphate
  modified_base 14: mod_base = OTHER; note = 2'-deoxy-2'-fluorouridine-3'-phosphate
  modified_base 15: mod_base = OTHER; note = 2'-O-methylguanosine-3'-phosphate
  modified_base 16: mod_base = OTHER; note = 2'-deoxy-2'-fluoroadenosine-3'-phosphate
  modified_base 18: mod_base = OTHER; note = 2'-O-methylcytidine-3'-phosphate
  modified_base 19: mod_base = OTHER; note = 2'-O-methylcytidine-3'-phosphate
  modified_base 20: mod_base = OTHER; note = 2'-deoxy-2'-fluorouridine-3'-phosphate
  modified_base 21: mod_base = OTHER; note = 2'-O-methylguanosine-3'-phosphorothioate
  modified_base 22: mod_base = OTHER; note = 2'-O-methylguanosine-3'-phosphorothioate
  modified_base 23: mod_base = OTHER; note = 2'-O-methylcytidine
ttaagacttgagatgatcctggc

SEQ ID NO: 274 - DNA, 23 bp, synthetic construct
  source 1..23: mol_type = other DNA
  modified_base 1: mod_base = OTHER; note = 2'-O-methyluridine-3'-phosphorothioate
  modified_base 2: mod_base = OTHER; note = 2'-deoxy-2'-fluorouridine-3'-phosphorothioate
  modified_base 3: mod_base = OTHER; note = 2'-O-methyladenosine-3'-phosphate
  modified_base 4: mod_base = OTHER; note = 2'-deoxy-2'-fluoroadenosine-3'-phosphate
  modified_base 5: mod_base = OTHER; note = 2'-O-methylguanosine-3'-phosphate
  modified_base 6: mod_base = OTHER; note = 2'-deoxy-2'-fluoroadenosine-3'-phosphate
  modified_base 7: mod_base = OTHER; note = 2'-O-methylcytidine-3'-phosphate
  modified_base 8: mod_base = OTHER; note = 2'-deoxy-2'-fluorouridine-3'-phosphate
  modified_base 9: mod_base = OTHER; note = 2'-O-methyluridine-3'-phosphate
  modified_base 10: mod_base = OTHER; note = 2'-deoxy-2'-fluoroguanosine-3'-phosphate
  modified_base 11: mod_base = OTHER; note = 2'-O-methyladenosine-3'-phosphate
  modified_base 12: mod_base = OTHER; note = 2'-O-methylguanosine-3'-phosphate
  modified_base 13: mod_base = OTHER; note = 2'-O-methyladenosine-3'-phosphate
  modified_base 14: mod_base = OTHER; note = 2'-deoxy-2'-fluorouridine-3'-phosphate
  modified_base 15: mod_base = OTHER; note = 2'-O-methylguanosine-3'-phosphate
  modified_base 16: mod_base = OTHER; note = 2'-deoxy-2'-fluoroadenosine-3'-phosphate
  modified_base 17: mod_base = OTHER; note = uridine-3'-phosphate
  modified_base 19: mod_base = OTHER; note = 2'-O-methylcytidine-3'-phosphate
  modified_base 20: mod_base = OTHER; note = 2'-deoxy-2'-fluorouridine-3'-phosphate
  modified_base 21: mod_base = OTHER; note = 2'-O-methylguanosine-3'-phosphorothioate
  modified_base 22: mod_base = OTHER; note = 2'-O-methylguanosine-3'-phosphorothioate
  modified_base 23: mod_base = OTHER; note = 2'-O-methylcytidine
  misc_feature 1..17: note = RNA
  misc_feature 19..23: note = RNA
  misc_feature 18: note = DNA
ttaagacttgagatgattctggc

SEQ ID NO: 275 - RNA, 21 nt, synthetic construct
  source 1..21: mol_type = other RNA
  modified_base 1: mod_base = OTHER; note = 2'-deoxy-2'-fluoroadenosine-3'-phosphorothioate
  modified_base 2: mod_base = OTHER; note = 2'-O-methyladenosine-3'-phosphorothioate
  modified_base 3: mod_base = OTHER; note = 2'-deoxy-2'-fluorocytidine-3'-phosphate
  modified_base 4: mod_base = OTHER; note = 2'-O-methyladenosine-3'-phosphate
  modified_base 5: mod_base = OTHER; note = 2'-deoxy-2'-fluoroguanosine-3'-phosphate
  modified_base 6: mod_base = OTHER; note = 2'-O-methyluridine-3'-phosphate
  modified_base 7: mod_base = OTHER; note = 2'-deoxy-2'-fluoroguanosine-3'-phosphate
  modified_base 8: mod_base = OTHER; note = 2'-O-methyluridine-3'-phosphate
  modified_base 9: mod_base = OTHER; note = 2'-deoxy-2'-fluorouridine-3'-phosphate
  modified_base 10: mod_base = OTHER; note = 2'-deoxy-2'-fluorocytidine-3'-phosphate
  modified_base 11: mod_base = OTHER; note = 2'-deoxy-2'-fluorouridine-3'-phosphate
  modified_base 12: mod_base = OTHER; note = 2'-O-methyluridine-3'-phosphate
  modified_base 13: mod_base = OTHER; note = 2'-deoxy-2'-fluoroguanosine-3'-phosphate
  modified_base 14: mod_base = OTHER; note = 2'-O-methylcytidine-3'-phosphate
  modified_base 15: mod_base = OTHER; note = 2'-deoxy-2'-fluorouridine-3'-phosphate
  modified_base 16: mod_base = OTHER; note = 2'-O-methylcytidine-3'-phosphate
  modified_base 17: mod_base = OTHER; note = 2'-deoxy-2'-fluorouridine-3'-phosphate
  modified_base 18: mod_base = OTHER; note = 2'-O-methyladenosine-3'-phosphate
  modified_base 19: mod_base = OTHER; note = 2'-deoxy-2'-fluorouridine-3'-phosphate
  modified_base 20: mod_base = OTHER; note = 2'-O-methyladenosine-3'-phosphate
  modified_base 21: mod_base = OTHER; note = 2'-deoxy-2'-fluoroadenosine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
aacagtgttcttgctctataa

SEQ ID NO: 276 - RNA, 21 nt, synthetic construct
  source 1..21: mol_type = other RNA
  modified_base 1: mod_base = OTHER; note = 2'-deoxy-2'-fluoroadenosine-3'-phosphorothioate
  modified_base 2: mod_base = OTHER; note = 2'-O-methyladenosine-3'-phosphorothioate
  modified_base 3: mod_base = OTHER; note = 2'-deoxy-2'-fluorocytidine-3'-phosphate
  modified_base 4: mod_base = OTHER; note = 2'-O-methyladenosine-3'-phosphate
  modified_base 5: mod_base = OTHER; note = 2'-deoxy-2'-fluoroguanosine-3'-phosphate
  modified_base 6: mod_base = OTHER; note = 2'-O-methyluridine-3'-phosphate
  modified_base 7: mod_base = OTHER; note = 2'-deoxy-2'-fluoroguanosine-3'-phosphate
  modified_base 8: mod_base = OTHER; note = 2'-O-methyluridine-3'-phosphate
  modified_base 9: mod_base = OTHER; note = 2'-deoxy-2'-fluorouridine-3'-phosphate
  modified_base 10: mod_base = OTHER; note = 2'-deoxy-2'-fluorocytidine-3'-phosphate
  modified_base 11: mod_base = OTHER; note = 2'-deoxy-2'-fluorouridine-3'-phosphate
  modified_base 12: mod_base = OTHER; note = 2'-O-methyluridine-3'-phosphate
  modified_base 13: mod_base = OTHER; note = 2'-deoxy-2'-fluoroguanosine-3'-phosphate
  modified_base 14: mod_base = OTHER; note = 2'-O-methylcytidine-3'-phosphate
  modified_base 15: mod_base = OTHER; note = 2'-deoxy-2'-fluorouridine-3'-phosphate
  modified_base 16: mod_base = OTHER; note = 2'-O-methylcytidine-3'-phosphate
  modified_base 17: mod_base = OTHER; note = 2'-deoxy-2'-fluorouridine-3'-phosphate
  modified_base 18: mod_base = OTHER; note = 2'-O-methyladenosine-3'-phosphate
  modified_base 19: mod_base = OTHER; note = 2'-deoxy-2'-fluorouridine-3'-phosphate
  modified_base 20: mod_base = OTHER; note = 2'-O-methyladenosine-3'-phosphate
  modified_base 21: mod_base = OTHER; note = 2'-deoxy-2'-fluoroadenosine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
aacagtgttcttgctctataa

SEQ ID NO: 277 - RNA, 21 nt, synthetic construct
  source 1..21: mol_type = other RNA
  modified_base 1: mod_base = OTHER; note = 2'-deoxy-2'-fluoroadenosine-3'-phosphorothioate
  modified_base 2: mod_base = OTHER; note = 2'-O-methyladenosine-3'-phosphorothioate
  modified_base 3: mod_base = OTHER; note = 2'-deoxy-2'-fluorocytidine-3'-phosphate
  modified_base 4: mod_base = OTHER; note = 2'-O-methyladenosine-3'-phosphate
  modified_base 5: mod_base = OTHER; note = 2'-deoxy-2'-fluoroguanosine-3'-phosphate
  modified_base 6: mod_base = OTHER; note = 2'-O-methyluridine-3'-phosphate
  modified_base 7: mod_base = OTHER; note = 2'-deoxy-2'-fluoroguanosine-3'-phosphate
  modified_base 8: mod_base = OTHER; note = 2'-O-methyluridine-3'-phosphate
  modified_base 9: mod_base = OTHER; note = 2'-deoxy-2'-fluorouridine-3'-phosphate
  modified_base 10: mod_base = OTHER; note = 2'-deoxy-2'-fluorocytidine-3'-phosphate
  modified_base 11: mod_base = OTHER; note = 2'-deoxy-2'-fluorouridine-3'-phosphate
  modified_base 12: mod_base = OTHER; note = 2'-O-methyluridine-3'-phosphate
  modified_base 13: mod_base = OTHER; note = 2'-deoxy-2'-fluoroguanosine-3'-phosphate
  modified_base 14: mod_base = OTHER; note = 2'-O-methylcytidine-3'-phosphate
  modified_base 15: mod_base = OTHER; note = 2'-deoxy-2'-fluorouridine-3'-phosphate
  modified_base 16: mod_base = OTHER; note = 2'-O-methylcytidine-3'-phosphate
  modified_base 17: mod_base = OTHER; note = 2'-deoxy-2'-fluorouridine-3'-phosphate
  modified_base 18: mod_base = OTHER; note = 2'-O-methyladenosine-3'-phosphate
  modified_base 19: mod_base = OTHER; note = 2'-deoxy-2'-fluorouridine-3'-phosphate
  modified_base 20: mod_base = OTHER; note = 2'-O-methyladenosine-3'-phosphate
  modified_base 21: mod_base = OTHER; note = 2'-deoxy-2'-fluoroadenosine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
aacagtgttcttgctctataa

SEQ ID NO: 278 - RNA, 21 nt, synthetic construct
  source 1..21: mol_type = other RNA
  modified_base 1: mod_base = OTHER; note = 2'-deoxy-2'-fluoroadenosine-3'-phosphorothioate
  modified_base 2: mod_base = OTHER; note = 2'-O-methyladenosine-3'-phosphorothioate
  modified_base 3: mod_base = OTHER; note = 2'-deoxy-2'-fluorocytidine-3'-phosphate
  modified_base 4: mod_base = OTHER; note = 2'-O-methyladenosine-3'-phosphate
  modified_base 5: mod_base = OTHER; note = 2'-deoxy-2'-fluoroguanosine-3'-phosphate
  modified_base 6: mod_base = OTHER; note = 2'-O-methyluridine-3'-phosphate
  modified_base 7: mod_base = OTHER; note = 2'-deoxy-2'-fluoroguanosine-3'-phosphate
  modified_base 8: mod_base = OTHER; note = 2'-O-methyluridine-3'-phosphate
  modified_base 9: mod_base = OTHER; note = 2'-deoxy-2'-fluorouridine-3'-phosphate
  modified_base 10: mod_base = OTHER; note = 2'-deoxy-2'-fluorocytidine-3'-phosphate
  modified_base 11: mod_base = OTHER; note = 2'-deoxy-2'-fluorouridine-3'-phosphate
  modified_base 12: mod_base = OTHER; note = 2'-O-methyluridine-3'-phosphate
  modified_base 13: mod_base = OTHER; note = 2'-deoxy-2'-fluoroguanosine-3'-phosphate
  modified_base 14: mod_base = OTHER; note = 2'-O-methylcytidine-3'-phosphate
  modified_base 15: mod_base = OTHER; note = 2'-deoxy-2'-fluorouridine-3'-phosphate
  modified_base 16: mod_base = OTHER; note = 2'-O-methylcytidine-3'-phosphate
  modified_base 17: mod_base = OTHER; note = 2'-deoxy-2'-fluorouridine-3'-phosphate
  modified_base 18: mod_base = OTHER; note = 2'-O-methyladenosine-3'-phosphate
  modified_base 19: mod_base = OTHER; note = 2'-deoxy-2'-fluorouridine-3'-phosphate
  modified_base 20: mod_base = OTHER; note = 2'-O-methyladenosine-3'-phosphate
  modified_base 21: mod_base = OTHER; note = 2'-deoxy-2'-fluoroadenosine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
aacagtgttcttgctctataa

SEQ ID NO: 279 - RNA, 21 nt, synthetic construct
  source 1..21: mol_type = other RNA
  modified_base 1: mod_base = OTHER; note = 2'-deoxy-2'-fluoroadenosine-3'-phosphorothioate
  modified_base 2: mod_base = OTHER; note = 2'-O-methyladenosine-3'-phosphorothioate
  modified_base 3: mod_base = OTHER; note = 2'-deoxy-2'-fluorocytidine-3'-phosphate
  modified_base 4: mod_base = OTHER; note = 2'-O-methyladenosine-3'-phosphate
  modified_base 5: mod_base = OTHER; note = 2'-deoxy-2'-fluoroguanosine-3'-phosphate
  modified_base 6: mod_base = OTHER; note = 2'-O-methyluridine-3'-phosphate
  modified_base 7: mod_base = OTHER; note = 2'-deoxy-2'-fluoroguanosine-3'-phosphate
  modified_base 8: mod_base = OTHER; note = 2'-O-methyluridine-3'-phosphate
  modified_base 9: mod_base = OTHER; note = 2'-deoxy-2'-fluorouridine-3'-phosphate
  modified_base 10: mod_base = OTHER; note = 2'-deoxy-2'-fluorocytidine-3'-phosphate
  modified_base 11: mod_base = OTHER; note = 2'-deoxy-2'-fluorouridine-3'-phosphate
  modified_base 12: mod_base = OTHER; note = 2'-O-methyluridine-3'-phosphate
  modified_base 13: mod_base = OTHER; note = 2'-deoxy-2'-fluoroguanosine-3'-phosphate
  modified_base 14: mod_base = OTHER; note = 2'-O-methylcytidine-3'-phosphate
  modified_base 15: mod_base = OTHER; note = 2'-deoxy-2'-fluorouridine-3'-phosphate
  modified_base 16: mod_base = OTHER; note = 2'-O-methylcytidine-3'-phosphate
  modified_base 17: mod_base = OTHER; note = 2'-deoxy-2'-fluorouridine-3'-phosphate
  modified_base 18: mod_base = OTHER; note = 2'-O-methyladenosine-3'-phosphate
  modified_base 19: mod_base = OTHER; note = 2'-deoxy-2'-fluorouridine-3'-phosphate
  modified_base 20: mod_base = OTHER; note = 2'-O-methyladenosine-3'-phosphate
  modified_base 21: mod_base = OTHER; note = 2'-deoxy-2'-fluoroadenosine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
aacagtgttcttgctctataa

SEQ ID NO: 280 - RNA, 21 nt, synthetic construct
  source 1..21: mol_type = other RNA
  modified_base 1: mod_base = OTHER; note = 2'-deoxy-2'-fluoroadenosine-3'-phosphorothioate
  modified_base 2: mod_base = OTHER; note = 2'-O-methyladenosine-3'-phosphorothioate
  modified_base 3: mod_base = OTHER; note = 2'-deoxy-2'-fluorocytidine-3'-phosphate
  modified_base 4: mod_base = OTHER; note = 2'-O-methyladenosine-3'-phosphate
  modified_base 5: mod_base = OTHER; note = 2'-deoxy-2'-fluoroguanosine-3'-phosphate
  modified_base 6: mod_base = OTHER; note = 2'-O-methyluridine-3'-phosphate
  modified_base 7: mod_base = OTHER; note = 2'-deoxy-2'-fluoroguanosine-3'-phosphate
  modified_base 8: mod_base = OTHER; note = 2'-O-methyluridine-3'-phosphate
  modified_base 9: mod_base = OTHER; note = 2'-deoxy-2'-fluorouridine-3'-phosphate
  modified_base 10: mod_base = OTHER; note = 2'-deoxy-2'-fluorocytidine-3'-phosphate
  modified_base 11: mod_base = OTHER; note = 2'-deoxy-2'-fluorouridine-3'-phosphate
  modified_base 12: mod_base = OTHER; note = 2'-O-methyluridine-3'-phosphate
  modified_base 13: mod_base = OTHER; note = 2'-deoxy-2'-fluoroguanosine-3'-phosphate
  modified_base 14: mod_base = OTHER; note = 2'-O-methylcytidine-3'-phosphate
  modified_base 15: mod_base = OTHER; note = 2'-deoxy-2'-fluorouridine-3'-phosphate
  modified_base 16: mod_base = OTHER; note = 2'-O-methylcytidine-3'-phosphate
  modified_base 17: mod_base = OTHER; note = 2'-deoxy-2'-fluorouridine-3'-phosphate
  modified_base 18: mod_base = OTHER; note = 2'-O-methyladenosine-3'-phosphate
  modified_base 19: mod_base = OTHER; note = 2'-deoxy-2'-fluorouridine-3'-phosphate
  modified_base 20: mod_base = OTHER; note = 2'-O-methyladenosine-3'-phosphate
  modified_base 21: mod_base = OTHER; note = 2'-deoxy-2'-fluoroadenosine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
aacagtgttcttgctctataa

SEQ ID NO: 281 - RNA, 21 nt, synthetic construct
  source 1..21: mol_type = other RNA
  modified_base 1: mod_base = OTHER; note = 2'-deoxy-2'-fluoroadenosine-3'-phosphorothioate
  modified_base 2: mod_base = OTHER; note = 2'-O-methyladenosine-3'-phosphorothioate
  modified_base 3: mod_base = OTHER; note = 2'-deoxy-2'-fluorocytidine-3'-phosphate
  modified_base 4: mod_base = OTHER; note = 2'-O-methyladenosine-3'-phosphate
  modified_base 5: mod_base = OTHER; note = 2'-deoxy-2'-fluoroguanosine-3'-phosphate
  modified_base 6: mod_base = OTHER; note = 2'-O-methyluridine-3'-phosphate
  modified_base 7: mod_base = OTHER; note = 2'-deoxy-2'-fluoroguanosine-3'-phosphate
  modified_base 8: mod_base = OTHER; note = 2'-O-methyluridine-3'-phosphate
  modified_base 9: mod_base = OTHER; note = 2'-deoxy-2'-fluorouridine-3'-phosphate
  modified_base 10: mod_base = OTHER; note = 2'-deoxy-2'-fluorocytidine-3'-phosphate
  modified_base 11: mod_base = OTHER; note = 2'-deoxy-2'-fluorouridine-3'-phosphate
  modified_base 12: mod_base = OTHER; note = 2'-O-methyluridine-3'-phosphate
  modified_base 13: mod_base = OTHER; note = 2'-deoxy-2'-fluoroguanosine-3'-phosphate
  modified_base 14: mod_base = OTHER; note = 2'-O-methylcytidine-3'-phosphate
  modified_base 15: mod_base = OTHER; note = 2'-deoxy-2'-fluorouridine-3'-phosphate
  modified_base 16: mod_base = OTHER; note = 2'-O-methylcytidine-3'-phosphate
  modified_base 17: mod_base = OTHER; note = 2'-deoxy-2'-fluorouridine-3'-phosphate
  modified_base 18: mod_base = OTHER; note = 2'-O-methyladenosine-3'-phosphate
  modified_base 19: mod_base = OTHER; note = 2'-deoxy-2'-fluorouridine-3'-phosphate
  modified_base 20: mod_base = OTHER; note = 2'-O-methyladenosine-3'-phosphate
  modified_base 21: mod_base = OTHER; note = 2'-deoxy-2'-fluoroadenosine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
aacagtgttcttgctctataa

SEQ ID NO: 282 - RNA, 21 nt, synthetic construct
  source 1..21: mol_type = other RNA
  modified_base 1: mod_base = OTHER; note = 2'-deoxy-2'-fluoroadenosine-3'-phosphorothioate
  modified_base 2: mod_base = OTHER; note = 2'-O-methyladenosine-3'-phosphorothioate
  modified_base 3: mod_base = OTHER; note = 2'-deoxy-2'-fluorocytidine-3'-phosphate
  modified_base 4: mod_base = OTHER; note = 2'-O-methyladenosine-3'-phosphate
  modified_base 5: mod_base = OTHER; note = 2'-deoxy-2'-fluoroguanosine-3'-phosphate
  modified_base 6: mod_base = OTHER; note = 2'-O-methyluridine-3'-phosphate
  modified_base 7: mod_base = OTHER; note = 2'-deoxy-2'-fluoroguanosine-3'-phosphate
  modified_base 8: mod_base = OTHER; note = 2'-O-methyluridine-3'-phosphate
  modified_base 9: mod_base = OTHER; note = 2'-deoxy-2'-fluorouridine-3'-phosphate
  modified_base 10: mod_base = OTHER; note = 2'-deoxy-2'-fluorocytidine-3'-phosphate
  modified_base 11: mod_base = OTHER; note = 2'-deoxy-2'-fluorouridine-3'-phosphate
  modified_base 12: mod_base = OTHER; note = 2'-O-methyluridine-3'-phosphate
  modified_base 13: mod_base = OTHER; note = 2'-deoxy-2'-fluoroguanosine-3'-phosphate
  modified_base 14: mod_base = OTHER; note = 2'-O-methylcytidine-3'-phosphate
  modified_base 15: mod_base = OTHER; note = 2'-deoxy-2'-fluorouridine-3'-phosphate
  modified_base 16: mod_base = OTHER; note = 2'-O-methylcytidine-3'-phosphate
  modified_base 17: mod_base = OTHER; note = 2'-deoxy-2'-fluorouridine-3'-phosphate
  modified_base 18: mod_base = OTHER; note = 2'-O-methyladenosine-3'-phosphate
  modified_base 19: mod_base = OTHER; note = 2'-deoxy-2'-fluorouridine-3'-phosphate
  modified_base 20: mod_base = OTHER; note = 2'-O-methyladenosine-3'-phosphate
  modified_base 21: mod_base = OTHER; note = 2'-deoxy-2'-fluoroadenosine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
aacagtgttcttgctctataa

SEQ ID NO: 283 - RNA, 21 nt, synthetic construct
  source 1..21: mol_type = other RNA
  modified_base 1: mod_base = OTHER; note = 2'-deoxy-2'-fluoroadenosine-3'-phosphorothioate
  modified_base 2: mod_base = OTHER; note = 2'-O-methyladenosine-3'-phosphorothioate
  modified_base 3: mod_base = OTHER; note = 2'-deoxy-2'-fluorocytidine-3'-phosphate
  modified_base 4: mod_base = OTHER; note = 2'-O-methyladenosine-3'-phosphate
  modified_base 5: mod_base = OTHER; note = 2'-deoxy-2'-fluoroguanosine-3'-phosphate
  modified_base 6: mod_base = OTHER; note = 2'-O-methyluridine-3'-phosphate
  modified_base 7: mod_base = OTHER; note = 2'-deoxy-2'-fluoroguanosine-3'-phosphate
  modified_base 8: mod_base = OTHER; note = 2'-O-methyluridine-3'-phosphate
  modified_base 9: mod_base = OTHER; note = 2'-deoxy-2'-fluorouridine-3'-phosphate
  modified_base 10: mod_base = OTHER; note = 2'-deoxy-2'-fluorocytidine-3'-phosphate
  modified_base 11: mod_base = OTHER; note = 2'-deoxy-2'-fluorouridine-3'-phosphate
  modified_base 12: mod_base = OTHER; note = 2'-O-methyluridine-3'-phosphate
  modified_base 13: mod_base = OTHER; note = 2'-deoxy-2'-fluoroguanosine-3'-phosphate
  modified_base 14: mod_base = OTHER; note = 2'-O-methylcytidine-3'-phosphate
  modified_base 15: mod_base = OTHER; note = 2'-deoxy-2'-fluorouridine-3'-phosphate
  modified_base 16: mod_base = OTHER; note = 2'-O-methylcytidine-3'-phosphate
  modified_base 17: mod_base = OTHER; note = 2'-deoxy-2'-fluorouridine-3'-phosphate
  modified_base 18: mod_base = OTHER; note = 2'-O-methyladenosine-3'-phosphate
  modified_base 19: mod_base = OTHER; note = 2'-deoxy-2'-fluorouridine-3'-phosphate
  modified_base 20: mod_base = OTHER; note = 2'-O-methyladenosine-3'-phosphate
  modified_base 21: mod_base = OTHER; note = 2'-deoxy-2'-fluoroadenosine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
aacagtgttcttgctctataa

SEQ ID NO: 284 - RNA, 21 nt, synthetic construct
  source 1..21: mol_type = other RNA
  modified_base 1: mod_base = OTHER; note = 2'-deoxy-2'-fluoroadenosine-3'-phosphorothioate
  modified_base 2: mod_base = OTHER; note = 2'-O-methyladenosine-3'-phosphorothioate
  modified_base 3: mod_base = OTHER; note = 2'-deoxy-2'-fluorocytidine-3'-phosphate
  modified_base 4: mod_base = OTHER; note = 2'-O-methyladenosine-3'-phosphate
  modified_base 5: mod_base = OTHER; note = 2'-deoxy-2'-fluoroguanosine-3'-phosphate
  modified_base 6: mod_base = OTHER; note = 2'-O-methyluridine-3'-phosphate
  modified_base 7: mod_base = OTHER; note = 2'-deoxy-2'-fluoroguanosine-3'-phosphate
  modified_base 8: mod_base = OTHER; note = 2'-O-methyluridine-3'-phosphate
  modified_base 9: mod_base = OTHER; note = 2'-deoxy-2'-fluorouridine-3'-phosphate
  modified_base 10: mod_base = OTHER; note = 2'-deoxy-2'-fluorocytidine-3'-phosphate
  modified_base 11: mod_base = OTHER; note = 2'-deoxy-2'-fluorouridine-3'-phosphate
  modified_base 12: mod_base = OTHER; note = 2'-O-methyluridine-3'-phosphate
  modified_base 13: mod_base = OTHER; note = 2'-deoxy-2'-fluoroguanosine-3'-phosphate
  modified_base 14: mod_base = OTHER; note = 2'-O-methylcytidine-3'-phosphate
  modified_base 15: mod_base = OTHER; note = 2'-deoxy-2'-fluorouridine-3'-phosphate
  modified_base 16: mod_base = OTHER; note = 2'-O-methylcytidine-3'-phosphate
  modified_base 17: mod_base = OTHER; note = 2'-deoxy-2'-fluorouridine-3'-phosphate
  modified_base 18: mod_base = OTHER; note = 2'-O-methyladenosine-3'-phosphate
  modified_base 19: mod_base = OTHER; note = 2'-deoxy-2'-fluorouridine-3'-phosphate
  modified_base 20: mod_base = OTHER; note = 2'-O-methyladenosine-3'-phosphate
  modified_base 21: mod_base = OTHER; note = 2'-deoxy-2'-fluoroadenosine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
aacagtgttcttgctctataa

SEQ ID NO: 285 - RNA, 21 nt, synthetic construct
  source 1..21: mol_type = other RNA
  modified_base 1: mod_base = OTHER; note = 2'-deoxy-2'-fluoroadenosine-3'-phosphorothioate
  modified_base 2: mod_base = OTHER; note = 2'-O-methyladenosine-3'-phosphorothioate
  modified_base 3: mod_base = OTHER; note = 2'-deoxy-2'-fluorocytidine-3'-phosphate
  modified_base 4: mod_base = OTHER; note = 2'-O-methyladenosine-3'-phosphate
  modified_base 5: mod_base = OTHER; note = 2'-deoxy-2'-fluoroguanosine-3'-phosphate
  modified_base 6: mod_base = OTHER; note = 2'-O-methyluridine-3'-phosphate
  modified_base 7: mod_base = OTHER; note = 2'-deoxy-2'-fluoroguanosine-3'-phosphate
  modified_base 8: mod_base = OTHER; note = 2'-O-methyluridine-3'-phosphate
  modified_base 9: mod_base = OTHER; note = 2'-deoxy-2'-fluorouridine-3'-phosphate
  modified_base 10: mod_base = OTHER; note = 2'-deoxy-2'-fluorocytidine-3'-phosphate
  modified_base 11: mod_base = OTHER; note = 2'-deoxy-2'-fluorouridine-3'-phosphate
  modified_base 12: mod_base = OTHER; note = 2'-O-methyluridine-3'-phosphate
  modified_base 13: mod_base = OTHER; note = 2'-deoxy-2'-fluoroguanosine-3'-phosphate
  modified_base 14: mod_base = OTHER; note = 2'-O-methylcytidine-3'-phosphate
  modified_base 15: mod_base = OTHER; note = 2'-deoxy-2'-fluorouridine-3'-phosphate
  modified_base 16: mod_base = OTHER; note = 2'-O-methylcytidine-3'-phosphate
  modified_base 17: mod_base = OTHER; note = 2'-deoxy-2'-fluorouridine-3'-phosphate
  modified_base 18: mod_base = OTHER; note = 2'-O-methyladenosine-3'-phosphate
  modified_base 19: mod_base = OTHER; note = 2'-deoxy-2'-fluorouridine-3'-phosphate
  modified_base 20: mod_base = OTHER; note = 2'-O-methyladenosine-3'-phosphate
  modified_base 21: mod_base = OTHER; note = 2'-deoxy-2'-fluoroadenosine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
aacagtgttcttgctctataa

SEQ ID NO: 286 - RNA, 21 nt, synthetic construct
  source 1..21: mol_type = other RNA
  modified_base 1: mod_base = OTHER; note = 2'-deoxy-2'-fluoroadenosine-3'-phosphorothioate
  modified_base 2: mod_base = OTHER; note = 2'-O-methyladenosine-3'-phosphorothioate
  modified_base 3: mod_base = OTHER; note = 2'-deoxy-2'-fluorocytidine-3'-phosphate
  modified_base 4: mod_base = OTHER; note = 2'-O-methyladenosine-3'-phosphate
  modified_base 5: mod_base = OTHER; note = 2'-deoxy-2'-fluoroguanosine-3'-phosphate
  modified_base 6: mod_base = OTHER; note = 2'-O-methyluridine-3'-phosphate
  modified_base 7: mod_base = OTHER; note = 2'-deoxy-2'-fluoroguanosine-3'-phosphate
  modified_base 8: mod_base = OTHER; note = 2'-O-methyluridine-3'-phosphate
  modified_base 9: mod_base = OTHER; note = 2'-deoxy-2'-fluorouridine-3'-phosphate
  modified_base 10: mod_base = OTHER; note = 2'-deoxy-2'-fluorocytidine-3'-phosphate
  modified_base 11: mod_base = OTHER; note = 2'-deoxy-2'-fluorouridine-3'-phosphate
  modified_base 12: mod_base = OTHER; note = 2'-O-methyluridine-3'-phosphate
  modified_base 13: mod_base = OTHER; note = 2'-deoxy-2'-fluoroguanosine-3'-phosphate
  modified_base 14: mod_base = OTHER; note = 2'-O-methylcytidine-3'-phosphate
  modified_base 15: mod_base = OTHER; note = 2'-deoxy-2'-fluorouridine-3'-phosphate
  modified_base 16: mod_base = OTHER; note = 2'-O-methylcytidine-3'-phosphate
  modified_base 17: mod_base = OTHER; note = 2'-deoxy-2'-fluorouridine-3'-phosphate
  modified_base 18: mod_base = OTHER; note = 2'-O-methyladenosine-3'-phosphate
  modified_base 19: mod_base = OTHER; note = 2'-deoxy-2'-fluorouridine-3'-phosphate
  modified_base 20: mod_base = OTHER; note = 2'-O-methyladenosine-3'-phosphate
  modified_base 21: mod_base = OTHER; note = 2'-deoxy-2'-fluoroadenosine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
aacagtgttcttgctctataa

SEQ ID NO: 287 - RNA, 21 nt, synthetic construct
  source 1..21: mol_type = other RNA
  modified_base 1: mod_base = OTHER; note = 2'-deoxy-2'-fluoroadenosine-3'-phosphorothioate
  modified_base 2: mod_base = OTHER; note = 2'-O-methyladenosine-3'-phosphorothioate
  modified_base 3: mod_base = OTHER; note = 2'-deoxy-2'-fluorocytidine-3'-phosphate
  modified_base 4: mod_base = OTHER; note = 2'-O-methyladenosine-3'-phosphate
  modified_base 5: mod_base = OTHER; note = 2'-deoxy-2'-fluoroguanosine-3'-phosphate
  modified_base 6: mod_base = OTHER; note = 2'-O-methyluridine-3'-phosphate
  modified_base 7: mod_base = OTHER; note = 2'-deoxy-2'-fluoroguanosine-3'-phosphate
  modified_base 8: mod_base = OTHER; note = 2'-O-methyluridine-3'-phosphate
  modified_base 9: mod_base = OTHER; note = 2'-deoxy-2'-fluorouridine-3'-phosphate
  modified_base 10: mod_base = OTHER; note = 2'-deoxy-2'-fluorocytidine-3'-phosphate
  modified_base 11: mod_base = OTHER; note = 2'-deoxy-2'-fluorouridine-3'-phosphate
  modified_base 12: mod_base = OTHER; note = 2'-O-methyluridine-3'-phosphate
  modified_base 13: mod_base = OTHER; note = 2'-deoxy-2'-fluoroguanosine-3'-phosphate
  modified_base 14: mod_base = OTHER; note = 2'-O-methylcytidine-3'-phosphate
  modified_base 15: mod_base = OTHER; note = 2'-deoxy-2'-fluorouridine-3'-phosphate
  modified_base 16: mod_base = OTHER; note = 2'-O-methylcytidine-3'-phosphate
  modified_base 17: mod_base = OTHER; note = 2'-deoxy-2'-fluorouridine-3'-phosphate
  modified_base 18: mod_base = OTHER; note = 2'-O-methyladenosine-3'-phosphate
  modified_base 19: mod_base = OTHER; note = 2'-deoxy-2'-fluorouridine-3'-phosphate
  modified_base 20: mod_base = OTHER; note = 2'-O-methyladenosine-3'-phosphate
  modified_base 21: mod_base = OTHER; note = 2'-deoxy-2'-fluoroadenosine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
aacagtgttcttgctctataa

SEQ ID NO: 288 - RNA, 21 nt, synthetic construct
  source 1..21: mol_type = other RNA
  modified_base 1: mod_base = OTHER; note = 2'-deoxy-2'-fluoroadenosine-3'-phosphorothioate
  modified_base 2: mod_base = OTHER; note = 2'-O-methyladenosine-3'-phosphorothioate
  modified_base 3: mod_base = OTHER; note = 2'-deoxy-2'-fluorocytidine-3'-phosphate
  modified_base 4: mod_base = OTHER; note = 2'-O-methyladenosine-3'-phosphate
  modified_base 5: mod_base = OTHER; note = 2'-deoxy-2'-fluoroguanosine-3'-phosphate
  modified_base 6: mod_base = OTHER; note = 2'-O-methyluridine-3'-phosphate
  modified_base 7: mod_base = OTHER; note = 2'-deoxy-2'-fluoroguanosine-3'-phosphate
  modified_base 8: mod_base = OTHER; note = 2'-O-methyluridine-3'-phosphate
  modified_base 9: mod_base = OTHER; note = 2'-deoxy-2'-fluorouridine-3'-phosphate
  modified_base 10: mod_base = OTHER; note = 2'-deoxy-2'-fluorocytidine-3'-phosphate
  modified_base 11: mod_base = OTHER; note = 2'-deoxy-2'-fluorouridine-3'-phosphate
  modified_base 12: mod_base = OTHER; note = 2'-O-methyluridine-3'-phosphate
  modified_base 13: mod_base = OTHER; note = 2'-deoxy-2'-fluoroguanosine-3'-phosphate
  modified_base 14: mod_base = OTHER; note = 2'-O-methylcytidine-3'-phosphate
  modified_base 15: mod_base = OTHER; note = 2'-deoxy-2'-fluorouridine-3'-phosphate
  modified_base 16: mod_base = OTHER; note = 2'-O-methylcytidine-3'-phosphate
  modified_base 17: mod_base = OTHER; note = 2'-deoxy-2'-fluorouridine-3'-phosphate
  modified_base 18: mod_base = OTHER; note = 2'-O-methyladenosine-3'-phosphate
  modified_base 19: mod_base = OTHER; note = 2'-deoxy-2'-fluorouridine-3'-phosphate
  modified_base 20: mod_base = OTHER; note = 2'-O-methyladenosine-3'-phosphate
  modified_base 21: mod_base = OTHER; note = 2'-deoxy-2'-fluoroadenosine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
aacagtgttcttgctctataa

SEQ ID NO: 289 - RNA, 21 nt, synthetic construct
  source 1..21: mol_type = other RNA
  modified_base 1: mod_base = OTHER; note = 2'-deoxy-2'-fluoroadenosine-3'-phosphorothioate
  modified_base 2: mod_base = OTHER; note = 2'-O-methyladenosine-3'-phosphorothioate
  modified_base 3: mod_base = OTHER; note = 2'-deoxy-2'-fluorocytidine-3'-phosphate
  modified_base 4: mod_base = OTHER; note = 2'-O-methyladenosine-3'-phosphate
  modified_base 5: mod_base = OTHER; note = 2'-deoxy-2'-fluoroguanosine-3'-phosphate
  modified_base 6: mod_base = OTHER; note = 2'-O-methyluridine-3'-phosphate
  modified_base 7: mod_base = OTHER; note = 2'-deoxy-2'-fluoroguanosine-3'-phosphate
  modified_base 8: mod_base = OTHER; note = 2'-O-methyluridine-3'-phosphate
  modified_base 9: mod_base = OTHER; note = 2'-deoxy-2'-fluorouridine-3'-phosphate
  modified_base 10: mod_base = OTHER; note = 2'-deoxy-2'-fluorocytidine-3'-phosphate
  modified_base 11: mod_base = OTHER; note = 2'-deoxy-2'-fluorouridine-3'-phosphate
  modified_base 12: mod_base = OTHER; note = 2'-O-methyluridine-3'-phosphate
  modified_base 13: mod_base = OTHER; note = 2'-deoxy-2'-fluoroguanosine-3'-phosphate
  modified_base 14: mod_base = OTHER; note = 2'-O-methylcytidine-3'-phosphate
  modified_base 15: mod_base = OTHER; note = 2'-deoxy-2'-fluorouridine-3'-phosphate
  modified_base 16: mod_base = OTHER; note = 2'-O-methylcytidine-3'-phosphate
  modified_base 17: mod_base = OTHER; note = 2'-deoxy-2'-fluorouridine-3'-phosphate
  modified_base 18: mod_base = OTHER; note = 2'-O-methyladenosine-3'-phosphate
  modified_base 19: mod_base = OTHER; note = 2'-deoxy-2'-fluorouridine-3'-phosphate
  modified_base 20: mod_base = OTHER; note = 2'-O-methyladenosine-3'-phosphate
  modified_base 21: mod_base = OTHER; note = 2'-deoxy-2'-fluoroadenosine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
aacagtgttcttgctctataa

SEQ ID NO: 290 - RNA, 21 nt, synthetic construct
  source 1..21: mol_type = other RNA
  modified_base 1: mod_base = OTHER; note = 2'-deoxy-2'-fluoroadenosine-3'-phosphorothioate
  modified_base 2: mod_base = OTHER; note = 2'-O-methyladenosine-3'-phosphorothioate
  modified_base 3: mod_base = OTHER; note = 2'-deoxy-2'-fluorocytidine-3'-phosphate
  modified_base 4: mod_base = OTHER; note = 2'-O-methyladenosine-3'-phosphate
  modified_base 5: mod_base = OTHER; note = 2'-deoxy-2'-fluoroguanosine-3'-phosphate
  modified_base 6: mod_base = OTHER; note = 2'-O-methyluridine-3'-phosphate
  modified_base 7: mod_base = OTHER; note = 2'-deoxy-2'-fluoroguanosine-3'-phosphate
  modified_base 8: mod_base = OTHER; note = 2'-O-methyluridine-3'-phosphate
  modified_base 9: mod_base = OTHER; note = 2'-deoxy-2'-fluorouridine-3'-phosphate
  modified_base 10: mod_base = OTHER; note = 2'-deoxy-2'-fluorocytidine-3'-phosphate
  modified_base 11: mod_base = OTHER; note = 2'-deoxy-2'-fluorouridine-3'-phosphate
  modified_base 12: mod_base = OTHER; note = 2'-O-methyluridine-3'-phosphate
  modified_base 13: mod_base = OTHER; note = 2'-deoxy-2'-fluoroguanosine-3'-phosphate
  modified_base 14: mod_base = OTHER; note = 2'-O-methylcytidine-3'-phosphate
  modified_base 15: mod_base = OTHER; note = 2'-deoxy-2'-fluorouridine-3'-phosphate
  modified_base 16: mod_base = OTHER; note = 2'-O-methylcytidine-3'-phosphate
  modified_base 17: mod_base = OTHER; note = 2'-deoxy-2'-fluorouridine-3'-phosphate
  modified_base 18: mod_base = OTHER; note = 2'-O-methyladenosine-3'-phosphate
  modified_base 19: mod_base = OTHER; note = 2'-deoxy-2'-fluorouridine-3'-phosphate
  modified_base 20: mod_base = OTHER; note = 2'-O-methyladenosine-3'-phosphate
  modified_base 21: mod_base = OTHER; note = 2'-deoxy-2'-fluoroadenosine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
aacagtgttcttgctctataa

SEQ ID NO: 291 - RNA, 21 nt, synthetic construct
  source 1..21: mol_type = other RNA
  modified_base 1: mod_base = OTHER; note = 2'-deoxy-2'-fluoroadenosine-3'-phosphorothioate
  modified_base 2: mod_base = OTHER; note = 2'-O-methyladenosine-3'-phosphorothioate
  modified_base 3: mod_base = OTHER; note = 2'-deoxy-2'-fluorocytidine-3'-phosphate
  modified_base 4: mod_base = OTHER; note = 2'-O-methyladenosine-3'-phosphate
  modified_base 5: mod_base = OTHER; note = 2'-deoxy-2'-fluoroguanosine-3'-phosphate
  modified_base 6: mod_base = OTHER; note = 2'-O-methyluridine-3'-phosphate
  modified_base 7: mod_base = OTHER; note = 2'-deoxy-2'-fluoroguanosine-3'-phosphate
  modified_base 8: mod_base = OTHER; note = 2'-O-methyluridine-3'-phosphate
  modified_base 9: mod_base = OTHER; note = 2'-deoxy-2'-fluorouridine-3'-phosphate
  modified_base 10: mod_base = OTHER; note = 2'-deoxy-2'-fluorocytidine-3'-phosphate
  modified_base 11: mod_base = OTHER; note = 2'-deoxy-2'-fluorouridine-3'-phosphate
  modified_base 12: mod_base = OTHER; note = 2'-O-methyluridine-3'-phosphate
  modified_base 13: mod_base = OTHER; note = 2'-deoxy-2'-fluoroguanosine-3'-phosphate
  modified_base 14: mod_base = OTHER; note = 2'-O-methylcytidine-3'-phosphate
  modified_base 15: mod_base = OTHER; note = 2'-deoxy-2'-fluorouridine-3'-phosphate
  modified_base 16: mod_base = OTHER; note = 2'-O-methylcytidine-3'-phosphate
  modified_base 17: mod_base = OTHER; note = 2'-deoxy-2'-fluorouridine-3'-phosphate
  modified_base 18: mod_base = OTHER; note = 2'-O-methyladenosine-3'-phosphate
  modified_base 19: mod_base = OTHER; note = 2'-deoxy-2'-fluorouridine-3'-phosphate
  modified_base 20: mod_base = OTHER; note = 2'-O-methyladenosine-3'-phosphate
  modified_base 21: mod_base = OTHER; note = 2'-deoxy-2'-fluoroadenosine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
aacagtgttcttgctctataa

SEQ ID NO: 292 - RNA, 21 nt, synthetic construct
  source 1..21: mol_type = other RNA
  modified_base 1: mod_base = OTHER; note = 2'-deoxy-2'-fluoroadenosine-3'-phosphorothioate
  modified_base 2: mod_base = OTHER; note = 2'-O-methyladenosine-3'-phosphorothioate
  modified_base 3: mod_base = OTHER; note = 2'-deoxy-2'-fluorocytidine-3'-phosphate
  modified_base 4: mod_base = OTHER; note = 2'-O-methyladenosine-3'-phosphate
  modified_base 5: mod_base = OTHER; note = 2'-deoxy-2'-fluoroguanosine-3'-phosphate
  modified_base 6: mod_base = OTHER; note = 2'-O-methyluridine-3'-phosphate
  modified_base 7: mod_base = OTHER; note = 2'-deoxy-2'-fluoroguanosine-3'-phosphate
  modified_base 8: mod_base = OTHER; note = 2'-O-methyluridine-3'-phosphate
  modified_base 9: mod_base = OTHER; note = 2'-deoxy-2'-fluorouridine-3'-phosphate
  modified_base 10: mod_base = OTHER; note = 2'-deoxy-2'-fluorocytidine-3'-phosphate
  modified_base 11: mod_base = OTHER; note = 2'-deoxy-2'-fluorouridine-3'-phosphate
  modified_base 12: mod_base = OTHER; note = 2'-O-methyluridine-3'-phosphate
  modified_base 13: mod_base = OTHER; note = 2'-deoxy-2'-fluoroguanosine-3'-phosphate
  modified_base 14: mod_base = OTHER; note = 2'-O-methylcytidine-3'-phosphate
  modified_base 15: mod_base = OTHER; note = 2'-deoxy-2'-fluorouridine-3'-phosphate
  modified_base 16: mod_base = OTHER; note = 2'-O-methylcytidine-3'-phosphate
  modified_base 17: mod_base = OTHER; note = 2'-deoxy-2'-fluorouridine-3'-phosphate
  modified_base 18: mod_base = OTHER; note = 2'-O-methyladenosine-3'-phosphate
  modified_base 19: mod_base = OTHER; note = 2'-deoxy-2'-fluorouridine-3'-phosphate
  modified_base 20: mod_base = OTHER; note = 2'-O-methyladenosine-3'-phosphate
  modified_base 21: mod_base = OTHER; note = 2'-deoxy-2'-fluoroadenosine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
aacagtgttcttgctctataa

SEQ ID NO: 293 - RNA, 21 nt, synthetic construct
  source 1..21: mol_type = other RNA
  modified_base 1: mod_base = OTHER; note = 2'-deoxy-2'-fluoroadenosine-3'-phosphorothioate
  modified_base 2: mod_base = OTHER; note = 2'-O-methyladenosine-3'-phosphorothioate
  modified_base 3: mod_base = OTHER; note = 2'-deoxy-2'-fluorocytidine-3'-phosphate
  modified_base 4: mod_base = OTHER; note = 2'-O-methyladenosine-3'-phosphate
  modified_base 5: mod_base = OTHER; note = 2'-deoxy-2'-fluoroguanosine-3'-phosphate
  modified_base 6: mod_base = OTHER; note = 2'-O-methyluridine-3'-phosphate
  modified_base 7: mod_base = OTHER; note = 2'-deoxy-2'-fluoroguanosine-3'-phosphate
  modified_base 8: mod_base = OTHER; note = 2'-O-methyluridine-3'-phosphate
  modified_base 9: mod_base = OTHER; note = 2'-deoxy-2'-fluorouridine-3'-phosphate
  modified_base 10: mod_base = OTHER; note = 2'-deoxy-2'-fluorocytidine-3'-phosphate
  modified_base 11: mod_base = OTHER; note = 2'-deoxy-2'-fluorouridine-3'-phosphate
  modified_base 12: mod_base = OTHER; note = 2'-O-methyluridine-3'-phosphate
  modified_base 13: mod_base = OTHER; note = 2'-deoxy-2'-fluoroguanosine-3'-phosphate
  modified_base 14: mod_base = OTHER; note = 2'-O-methylcytidine-3'-phosphate
  modified_base 15: mod_base = OTHER; note = 2'-deoxy-2'-fluorouridine-3'-phosphate
  modified_base 16: mod_base = OTHER; note = 2'-O-methylcytidine-3'-phosphate
  modified_base 17: mod_base = OTHER; note = 2'-deoxy-2'-fluorouridine-3'-phosphate
  modified_base 18: mod_base = OTHER; note = 2'-O-methyladenosine-3'-phosphate
  modified_base 19: mod_base = OTHER; note = 2'-deoxy-2'-fluorouridine-3'-phosphate
  modified_base 20: mod_base = OTHER; note = 2'-O-methyladenosine-3'-phosphate
  modified_base 21: mod_base = OTHER; note = 2'-deoxy-2'-fluoroadenosine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
aacagtgttcttgctctataa

SEQ ID NO: 294 - RNA, 21 nt, synthetic construct
  source 1..21: mol_type = other RNA
  modified_base 1: mod_base = OTHER; note = 2'-deoxy-2'-fluoroadenosine-3'-phosphorothioate
  modified_base 2: mod_base = OTHER; note = 2'-O-methyladenosine-3'-phosphorothioate
  modified_base 3: mod_base = OTHER; note = 2'-deoxy-2'-fluorocytidine-3'-phosphate
  modified_base 4: mod_base = OTHER; note = 2'-O-methyladenosine-3'-phosphate
  modified_base 5: mod_base = OTHER; note = 2'-deoxy-2'-fluoroguanosine-3'-phosphate
  modified_base 6: mod_base = OTHER; note = 2'-O-methyluridine-3'-phosphate
  modified_base 7: mod_base = OTHER; note = 2'-deoxy-2'-fluoroguanosine-3'-phosphate
  modified_base 8: mod_base = OTHER; note = 2'-O-methyluridine-3'-phosphate
  modified_base 9: mod_base = OTHER; note = 2'-deoxy-2'-fluorouridine-3'-phosphate
  modified_base 10: mod_base = OTHER; note = 2'-deoxy-2'-fluorocytidine-3'-phosphate
  modified_base 11: mod_base = OTHER; note = 2'-deoxy-2'-fluorouridine-3'-phosphate
  modified_base 12: mod_base = OTHER; note = 2'-O-methyluridine-3'-phosphate
  modified_base 13: mod_base = OTHER; note = 2'-deoxy-2'-fluoroguanosine-3'-phosphate
  modified_base 14: mod_base = OTHER; note = 2'-O-methylcytidine-3'-phosphate
  modified_base 15: mod_base = OTHER; note = 2'-deoxy-2'-fluorouridine-3'-phosphate
  modified_base 16: mod_base = OTHER; note = 2'-O-methylcytidine-3'-phosphate
  modified_base 17: mod_base = OTHER; note = 2'-deoxy-2'-fluorouridine-3'-phosphate
  modified_base 18: mod_base = OTHER; note = 2'-O-methyladenosine-3'-phosphate
  modified_base 19: mod_base = OTHER; note = 2'-deoxy-2'-fluorouridine-3'-phosphate
  modified_base 20: mod_base = OTHER; note = 2'-O-methyladenosine-3'-phosphate
  modified_base 21: mod_base = OTHER; note = 2'-deoxy-2'-fluoroadenosine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
aacagtgttcttgctctataa

SEQ ID NO: 295 - RNA, 21 nt, synthetic construct
  source 1..21: mol_type = other RNA
  modified_base 1: mod_base = OTHER; note = 2'-deoxy-2'-fluoroadenosine-3'-phosphorothioate
  modified_base 2: mod_base = OTHER; note = 2'-O-methyladenosine-3'-phosphorothioate
  modified_base 3: mod_base = OTHER; note = 2'-deoxy-2'-fluorocytidine-3'-phosphate
  modified_base 4: mod_base = OTHER; note = 2'-O-methyladenosine-3'-phosphate
  modified_base 5: mod_base = OTHER; note = 2'-deoxy-2'-fluoroguanosine-3'-phosphate
  modified_base 6: mod_base = OTHER; note = 2'-O-methyluridine-3'-phosphate
  modified_base 7: mod_base = OTHER; note = 2'-deoxy-2'-fluoroguanosine-3'-phosphate
  modified_base 8: mod_base = OTHER; note = 2'-O-methyluridine-3'-phosphate
  modified_base 9: mod_base = OTHER; note = 2'-deoxy-2'-fluorouridine-3'-phosphate
  modified_base 10: mod_base = OTHER; note = 2'-deoxy-2'-fluorocytidine-3'-phosphate
  modified_base 11: mod_base = OTHER; note = 2'-deoxy-2'-fluorouridine-3'-phosphate
  modified_base 12: mod_base = OTHER; note = 2'-O-methyluridine-3'-phosphate
  modified_base 13: mod_base = OTHER; note = 2'-deoxy-2'-fluoroguanosine-3'-phosphate
  modified_base 14: mod_base = OTHER; note = 2'-O-methylcytidine-3'-phosphate
  modified_base 15: mod_base = OTHER; note = 2'-deoxy-2'-fluorouridine-3'-phosphate
  modified_base 16: mod_base = OTHER; note = 2'-O-methylcytidine-3'-phosphate
  modified_base 17: mod_base = OTHER; note = 2'-deoxy-2'-fluorouridine-3'-phosphate
  modified_base 18: mod_base = OTHER; note = 2'-O-methyladenosine-3'-phosphate
  modified_base 19: mod_base = OTHER; note = 2'-deoxy-2'-fluorouridine-3'-phosphate
  modified_base 20: mod_base = OTHER; note = 2'-O-methyladenosine-3'-phosphate
  modified_base 21: mod_base = OTHER; note = 2'-deoxy-2'-fluoroadenosine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
aacagtgttcttgctctataa

SEQ ID NO: 296 - RNA, 21 nt, synthetic construct
  source 1..21: mol_type = other RNA
  modified_base 1: mod_base = OTHER; note = 2'-deoxy-2'-fluoroadenosine-3'-phosphorothioate
  modified_base 2: mod_base = OTHER; note = 2'-O-methyladenosine-3'-phosphorothioate
  modified_base 3: mod_base = OTHER; note = 2'-deoxy-2'-fluorocytidine-3'-phosphate
  modified_base 4: mod_base = OTHER; note = 2'-O-methyladenosine-3'-phosphate
  modified_base 5: mod_base = OTHER; note = 2'-deoxy-2'-fluoroguanosine-3'-phosphate
  modified_base 6: mod_base = OTHER; note = 2'-O-methyluridine-3'-phosphate
  modified_base 7: mod_base = OTHER; note = 2'-deoxy-2'-fluoroguanosine-3'-phosphate
  modified_base 8: mod_base = OTHER; note = 2'-O-methyluridine-3'-phosphate
  modified_base 9: mod_base = OTHER; note = 2'-deoxy-2'-fluorouridine-3'-phosphate
  modified_base 10: mod_base = OTHER; note = 2'-deoxy-2'-fluorocytidine-3'-phosphate
  modified_base 11: mod_base = OTHER; note = 2'-deoxy-2'-fluorouridine-3'-phosphate
  modified_base 12: mod_base = OTHER; note = 2'-O-methyluridine-3'-phosphate
  modified_base 13: mod_base = OTHER; note = 2'-deoxy-2'-fluoroguanosine-3'-phosphate
  modified_base 14: mod_base = OTHER; note = 2'-O-methylcytidine-3'-phosphate
  modified_base 15: mod_base = OTHER; note = 2'-deoxy-2'-fluorouridine-3'-phosphate
  modified_base 16: mod_base = OTHER; note = 2'-O-methylcytidine-3'-phosphate
  modified_base 17: mod_base = OTHER; note = 2'-deoxy-2'-fluorouridine-3'-phosphate
  modified_base 18: mod_base = OTHER; note = 2'-O-methyladenosine-3'-phosphate
  modified_base 19: mod_base = OTHER; note = 2'-deoxy-2'-fluorouridine-3'-phosphate
  modified_base 20: mod_base = OTHER; note = 2'-O-methyladenosine-3'-phosphate
  modified_base 21: mod_base = OTHER; note = 2'-deoxy-2'-fluoroadenosine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
aacagtgttcttgctctataa

SEQ ID NO: 297 - RNA, 21 nt, synthetic construct
  source 1..21: mol_type = other RNA
  modified_base 1: mod_base = OTHER; note = 2'-deoxy-2'-fluoroadenosine-3'-phosphorothioate
  modified_base 2: mod_base = OTHER; note = 2'-O-methyladenosine-3'-phosphorothioate
  modified_base 3: mod_base = OTHER; note = 2'-deoxy-2'-fluorocytidine-3'-phosphate
  modified_base 4: mod_base = OTHER; note = 2'-O-methyladenosine-3'-phosphate
  modified_base 5: mod_base = OTHER; note = 2'-deoxy-2'-fluoroguanosine-3'-phosphate
  modified_base 6: mod_base = OTHER; note = 2'-O-methyluridine-3'-phosphate
  modified_base 7: mod_base = OTHER; note = 2'-deoxy-2'-fluoroguanosine-3'-phosphate
  modified_base 8: mod_base = OTHER; note = 2'-O-methyluridine-3'-phosphate
  modified_base 9: mod_base = OTHER; note = 2'-deoxy-2'-fluorouridine-3'-phosphate
  modified_base 10: mod_base = OTHER; note = 2'-deoxy-2'-fluorocytidine-3'-phosphate
  modified_base 11: mod_base = OTHER; note = 2'-deoxy-2'-fluorouridine-3'-phosphate
  modified_base 12: mod_base = OTHER; note = 2'-O-methyluridine-3'-phosphate
  modified_base 13: mod_base = OTHER; note = 2'-deoxy-2'-fluoroguanosine-3'-phosphate
  modified_base 14: mod_base = OTHER; note = 2'-O-methylcytidine-3'-phosphate
  modified_base 15: mod_base = OTHER; note = 2'-deoxy-2'-fluorouridine-3'-phosphate
  modified_base 16: mod_base = OTHER; note = 2'-O-methylcytidine-3'-phosphate
  modified_base 17: mod_base = OTHER; note = 2'-deoxy-2'-fluorouridine-3'-phosphate
  modified_base 18: mod_base = OTHER; note = 2'-O-methyladenosine-3'-phosphate
  modified_base 19: mod_base = OTHER; note = 2'-deoxy-2'-fluorouridine-3'-phosphate
  modified_base 20: mod_base = OTHER; note = 2'-O-methyladenosine-3'-phosphate
  modified_base 21: mod_base = OTHER; note = 2'-deoxy-2'-fluoroadenosine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
aacagtgttcttgctctataa

SEQ ID NO: 298 - RNA, 21 nt, synthetic construct
  source 1..21: mol_type = other RNA
  modified_base 1: mod_base = OTHER; note = 2'-deoxy-2'-fluoroadenosine-3'-phosphorothioate
  modified_base 2: mod_base = OTHER; note = 2'-O-methyladenosine-3'-phosphorothioate
  modified_base 3: mod_base = OTHER; note = 2'-deoxy-2'-fluorocytidine-3'-phosphate
  modified_base 4: mod_base = OTHER; note = 2'-O-methyladenosine-3'-phosphate
  modified_base 5: mod_base = OTHER; note = 2'-deoxy-2'-fluoroguanosine-3'-phosphate
  modified_base 6: mod_base = OTHER; note = 2'-O-methyluridine-3'-phosphate
  modified_base 7: mod_base = OTHER; note = 2'-deoxy-2'-fluoroguanosine-3'-phosphate
  modified_base 8: mod_base = OTHER; note = 2'-O-methyluridine-3'-phosphate
  modified_base 9: mod_base = OTHER; note = 2'-deoxy-2'-fluorouridine-3'-phosphate
  modified_base 10: mod_base = OTHER; note = 2'-deoxy-2'-fluorocytidine-3'-phosphate
  modified_base 11: mod_base = OTHER; note = 2'-deoxy-2'-fluorouridine-3'-phosphate
  modified_base 12: mod_base = OTHER; note = 2'-O-methyluridine-3'-phosphate
  modified_base 13: mod_base = OTHER; note = 2'-deoxy-2'-fluoroguanosine-3'-phosphate
  modified_base 14: mod_base = OTHER; note = 2'-O-methylcytidine-3'-phosphate
  modified_base 15: mod_base = OTHER; note = 2'-deoxy-2'-fluorouridine-3'-phosphate
  modified_base 16: mod_base = OTHER; note = 2'-O-methylcytidine-3'-phosphate
  modified_base 17: mod_base = OTHER; note = 2'-deoxy-2'-fluorouridine-3'-phosphate
  modified_base 18: mod_base = OTHER; note = 2'-O-methyladenosine-3'-phosphate
  modified_base 19: mod_base = OTHER; note = 2'-deoxy-2'-fluorouridine-3'-phosphate
  modified_base 20: mod_base = OTHER; note = 2'-O-methyladenosine-3'-phosphate
  modified_base 21: mod_base = OTHER; note = 2'-deoxy-2'-fluoroadenosine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
aacagtgttcttgctctataa

SEQ ID NO: 299 - RNA, 21 nt, synthetic construct
  source 1..21: mol_type = other RNA
  modified_base 1: mod_base = OTHER; note = 2'-deoxy-2'-fluoroadenosine-3'-phosphorothioate
  modified_base 2: mod_base = OTHER; note = 2'-O-methyladenosine-3'-phosphorothioate
  modified_base 3: mod_base = OTHER; note = 2'-deoxy-2'-fluorocytidine-3'-phosphate
  modified_base 4: mod_base = OTHER; note = 2'-O-methyladenosine-3'-phosphate
  modified_base 5: mod_base = OTHER; note = 2'-deoxy-2'-fluoroguanosine-3'-phosphate
  modified_base 6: mod_base = OTHER; note = 2'-O-methyluridine-3'-phosphate
  modified_base 7: mod_base = OTHER; note = 2'-deoxy-2'-fluoroguanosine-3'-phosphate
  modified_base 8: mod_base = OTHER; note = 2'-O-methyluridine-3'-phosphate
  modified_base 9: mod_base = OTHER; note = 2'-deoxy-2'-fluorouridine-3'-phosphate
  modified_base 10: mod_base = OTHER; note = 2'-deoxy-2'-fluorocytidine-3'-phosphate
  modified_base 11: mod_base = OTHER; note = 2'-deoxy-2'-fluorouridine-3'-phosphate
  modified_base 12: mod_base = OTHER; note = 2'-O-methyluridine-3'-phosphate
  modified_base 13: mod_base = OTHER; note = 2'-deoxy-2'-fluoroguanosine-3'-phosphate
  modified_base 14: mod_base = OTHER; note = 2'-O-methylcytidine-3'-phosphate
  modified_base 15: mod_base = OTHER; note = 2'-deoxy-2'-fluorouridine-3'-phosphate
  modified_base 16: mod_base = OTHER; note = 2'-O-methylcytidine-3'-phosphate
  modified_base 17: mod_base = OTHER; note = 2'-deoxy-2'-fluorouridine-3'-phosphate
  modified_base 18: mod_base = OTHER; note = 2'-O-methyladenosine-3'-phosphate
  modified_base 19: mod_base = OTHER; note = 2'-deoxy-2'-fluorouridine-3'-phosphate
  modified_base 20: mod_base = OTHER; note = 2'-O-methyladenosine-3'-phosphate
  modified_base 21: mod_base = OTHER; note = 2'-deoxy-2'-fluoroadenosine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
aacagtgttcttgctctataa

SEQ ID NO: 300 - RNA, 21 nt, synthetic construct
  source 1..21: mol_type = other RNA
  modified_base 1: mod_base = OTHER; note = Adenosine-glycol nucleic acid (GNA), S-isomer phosphorothioate
  modified_base 2: mod_base = OTHER; note = 2'-O-methyladenosine-3'-phosphorothioate
  modified_base 3: mod_base = OTHER; note = 2'-deoxy-2'-fluorocytidine-3'-phosphate
  modified_base 4: mod_base = OTHER; note = 2'-O-methyladenosine-3'-phosphate
  modified_base 5: mod_base = OTHER; note = 2'-deoxy-2'-fluoroguanosine-3'-phosphate
  modified_base 6: mod_base = OTHER; note = 2'-O-methyluridine-3'-phosphate
  modified_base 7: mod_base = OTHER; note = 2'-deoxy-2'-fluoroguanosine-3'-phosphate
  modified_base 8: mod_base = OTHER; note = 2'-O-methyluridine-3'-phosphate
  modified_base 9: mod_base = OTHER; note = 2'-deoxy-2'-fluorouridine-3'-phosphate
  modified_base 10: mod_base = OTHER; note = 2'-deoxy-2'-fluorocytidine-3'-phosphate
  modified_base 11: mod_base = OTHER; note = 2'-deoxy-2'-fluorouridine-3'-phosphate
  modified_base 12: mod_base = OTHER; note = 2'-O-methyluridine-3'-phosphate
  modified_base 13: mod_base = OTHER; note = 2'-deoxy-2'-fluoroguanosine-3'-phosphate
  modified_base 14: mod_base = OTHER; note = 2'-O-methylcytidine-3'-phosphate
  modified_base 15: mod_base = OTHER; note = 2'-deoxy-2'-fluorouridine-3'-phosphate
  modified_base 16: mod_base = OTHER; note = 2'-O-methylcytidine-3'-phosphate
  modified_base 17: mod_base = OTHER; note = 2'-deoxy-2'-fluorouridine-3'-phosphate
  modified_base 18: mod_base = OTHER; note = 2'-O-methyladenosine-3'-phosphate
  modified_base 19: mod_base = OTHER; note = 2'-deoxy-2'-fluorouridine-3'-phosphate
  modified_base 20: mod_base = OTHER; note = 2'-O-methyladenosine-3'-phosphate
  modified_base 21: mod_base = OTHER; note = 2'-deoxy-2'-fluoroadenosine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
aacagtgttcttgctctataa

SEQ ID NO: 301 - RNA, 21 nt, synthetic construct
  source 1..21: mol_type = other RNA
  modified_base 1: mod_base = OTHER; note = 2'-deoxy-2'-fluoroadenosine-3'-phosphorothioate
  modified_base 2: mod_base = OTHER; note = Adenosine-glycol nucleic acid (GNA), S-isomer phosphorothioate
  modified_base 3: mod_base = OTHER; note = 2'-deoxy-2'-fluorocytidine-3'-phosphate
  modified_base 4: mod_base = OTHER; note = 2'-O-methyladenosine-3'-phosphate
  modified_base 5: mod_base = OTHER; note = 2'-deoxy-2'-fluoroguanosine-3'-phosphate
  modified_base 6: mod_base = OTHER; note = 2'-O-methyluridine-3'-phosphate
  modified_base 7: mod_base = OTHER; note = 2'-deoxy-2'-fluoroguanosine-3'-phosphate
  modified_base 8: mod_base = OTHER; note = 2'-O-methyluridine-3'-phosphate
  modified_base 9: mod_base = OTHER; note = 2'-deoxy-2'-fluorouridine-3'-phosphate
  modified_base 10: mod_base = OTHER; note = 2'-deoxy-2'-fluorocytidine-3'-phosphate
  modified_base 11: mod_base = OTHER; note = 2'-deoxy-2'-fluorouridine-3'-phosphate
  modified_base 12: mod_base = OTHER; note = 2'-O-methyluridine-3'-phosphate
  modified_base 13: mod_base = OTHER; note = 2'-deoxy-2'-fluoroguanosine-3'-phosphate
  modified_base 14: mod_base = OTHER; note = 2'-O-methylcytidine-3'-phosphate
  modified_base 15: mod_base = OTHER; note = 2'-deoxy-2'-fluorouridine-3'-phosphate
  modified_base 16: mod_base = OTHER; note = 2'-O-methylcytidine-3'-phosphate
  modified_base 17: mod_base = OTHER; note = 2'-deoxy-2'-fluorouridine-3'-phosphate
  modified_base 18: mod_base = OTHER; note = 2'-O-methyladenosine-3'-phosphate
  modified_base 19: mod_base = OTHER; note = 2'-deoxy-2'-fluorouridine-3'-phosphate
  modified_base 20: mod_base = OTHER; note = 2'-O-methyladenosine-3'-phosphate
  modified_base 21: mod_base = OTHER; note = 2'-deoxy-2'-fluoroadenosine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
aacagtgttcttgctctataa

SEQ ID NO: 302 - RNA, 21 nt, synthetic construct
  source 1..21: mol_type = other RNA
  modified_base 1: mod_base = OTHER; note = 2'-deoxy-2'-fluoroadenosine-3'-phosphorothioate
  modified_base 2: mod_base = OTHER; note = 2'-O-methyladenosine-3'-phosphorothioate
  modified_base 3: mod_base = OTHER; note = Cytidine-glycol nucleic acid (GNA), S-isomer
  modified_base 4: mod_base = OTHER; note = 2'-O-methyladenosine-3'-phosphate
  modified_base 5: mod_base = OTHER; note = 2'-deoxy-2'-fluoroguanosine-3'-phosphate
  modified_base 6: mod_base = OTHER; note = 2'-O-methyluridine-3'-phosphate
  modified_base 7: mod_base = OTHER; note = 2'-deoxy-2'-fluoroguanosine-3'-phosphate
  modified_base 8: mod_base = OTHER; note = 2'-O-methyluridine-3'-phosphate
  modified_base 9: mod_base = OTHER; note = 2'-deoxy-2'-fluorouridine-3'-phosphate
  modified_base 10: mod_base = OTHER; note = 2'-deoxy-2'-fluorocytidine-3'-phosphate
  modified_base 11: mod_base = OTHER; note = 2'-deoxy-2'-fluorouridine-3'-phosphate
  modified_base 12: mod_base = OTHER; note = 2'-O-methyluridine-3'-phosphate
  modified_base 13: mod_base = OTHER; note = 2'-deoxy-2'-fluoroguanosine-3'-phosphate
  modified_base 14: mod_base = OTHER; note = 2'-O-methylcytidine-3'-phosphate
  modified_base 15: mod_base = OTHER; note = 2'-deoxy-2'-fluorouridine-3'-phosphate
  modified_base 16: mod_base = OTHER; note = 2'-O-methylcytidine-3'-phosphate
  modified_base 17: mod_base = OTHER; note = 2'-deoxy-2'-fluorouridine-3'-phosphate
  modified_base 18: mod_base = OTHER; note = 2'-O-methyladenosine-3'-phosphate
  modified_base 19: mod_base = OTHER; note = 2'-deoxy-2'-fluorouridine-3'-phosphate
  modified_base 20: mod_base = OTHER; note = 2'-O-methyladenosine-3'-phosphate
  modified_base 21: mod_base = OTHER; note = 2'-deoxy-2'-fluoroadenosine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
aacagtgttcttgctctataa

SEQ ID NO: 303 - RNA, 21 nt, synthetic construct
  source 1..21: mol_type = other RNA
  modified_base 1: mod_base = OTHER; note = 2'-deoxy-2'-fluoroadenosine-3'-phosphorothioate
  modified_base 2: mod_base = OTHER; note = 2'-O-methyladenosine-3'-phosphorothioate
  modified_base 3: mod_base = OTHER; note = 2'-deoxy-2'-fluorocytidine-3'-phosphate
  modified_base 4: mod_base = OTHER; note = Adenosine-glycol nucleic acid (GNA), S-isomer
  modified_base 5: mod_base = OTHER; note = 2'-deoxy-2'-fluoroguanosine-3'-phosphate
  modified_base 6: mod_base = OTHER; note = 2'-O-methyluridine-3'-phosphate
  modified_base 7: mod_base = OTHER; note = 2'-deoxy-2'-fluoroguanosine-3'-phosphate
  modified_base 8: mod_base = OTHER; note = 2'-O-methyluridine-3'-phosphate
  modified_base 9: mod_base = OTHER; note = 2'-deoxy-2'-fluorouridine-3'-phosphate
  modified_base 10: mod_base = OTHER; note = 2'-deoxy-2'-fluorocytidine-3'-phosphate
  modified_base 11: mod_base = OTHER; note = 2'-deoxy-2'-fluorouridine-3'-phosphate
  modified_base 12: mod_base = OTHER; note = 2'-O-methyluridine-3'-phosphate
  modified_base 13: mod_base = OTHER; note = 2'-deoxy-2'-fluoroguanosine-3'-phosphate
  modified_base 14: mod_base = OTHER; note = 2'-O-methylcytidine-3'-phosphate
  modified_base 15: mod_base = OTHER; note = 2'-deoxy-2'-fluorouridine-3'-phosphate
  modified_base 16: mod_base = OTHER; note = 2'-O-methylcytidine-3'-phosphate
  modified_base 17: mod_base = OTHER; note = 2'-deoxy-2'-fluorouridine-3'-phosphate
  modified_base 18: mod_base = OTHER; note = 2'-O-methyladenosine-3'-phosphate
  modified_base 19: mod_base = OTHER; note = 2'-deoxy-2'-fluorouridine-3'-phosphate
  modified_base 20: mod_base = OTHER; note = 2'-O-methyladenosine-3'-phosphate
  modified_base 21: mod_base = OTHER; note = 2'-deoxy-2'-fluoroadenosine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
aacagtgttcttgctctataa

SEQ ID NO: 304 - RNA, 21 nt, synthetic construct
  source 1..21: mol_type = other RNA
  modified_base 1: mod_base = OTHER; note = 2'-deoxy-2'-fluoroadenosine-3'-phosphorothioate
  modified_base 2: mod_base = OTHER; note = 2'-O-methyladenosine-3'-phosphorothioate
  modified_base 3: mod_base = OTHER; note = 2'-deoxy-2'-fluorocytidine-3'-phosphate
  modified_base 4: mod_base = OTHER; note = 2'-O-methyladenosine-3'-phosphate
  modified_base 5: mod_base = OTHER; note = Guanosine-glycol nucleic acid (GNA), S-isomer
  modified_base 6: mod_base = OTHER; note = 2'-O-methyluridine-3'-phosphate
  modified_base 7: mod_base = OTHER; note = 2'-deoxy-2'-fluoroguanosine-3'-phosphate
  modified_base 8: mod_base = OTHER; note = 2'-O-methyluridine-3'-phosphate
  modified_base 9: mod_base = OTHER; note = 2'-deoxy-2'-fluorouridine-3'-phosphate
  modified_base 10: mod_base = OTHER; note = 2'-deoxy-2'-fluorocytidine-3'-phosphate
  modified_base 11: mod_base = OTHER; note = 2'-deoxy-2'-fluorouridine-3'-phosphate
  modified_base 12: mod_base = OTHER; note = 2'-O-methyluridine-3'-phosphate
  modified_base 13: mod_base = OTHER; note = 2'-deoxy-2'-fluoroguanosine-3'-phosphate
  modified_base 14: mod_base = OTHER; note = 2'-O-methylcytidine-3'-phosphate
  modified_base 15: mod_base = OTHER; note = 2'-deoxy-2'-fluorouridine-3'-phosphate
  modified_base 16: mod_base = OTHER; note = 2'-O-methylcytidine-3'-phosphate
  modified_base 17: mod_base = OTHER; note = 2'-deoxy-2'-fluorouridine-3'-phosphate
  modified_base 18: mod_base = OTHER; note = 2'-O-methyladenosine-3'-phosphate
  modified_base 19: mod_base = OTHER; note = 2'-deoxy-2'-fluorouridine-3'-phosphate
  modified_base 20: mod_base = OTHER; note = 2'-O-methyladenosine-3'-phosphate
  modified_base 21: mod_base = OTHER; note = 2'-deoxy-2'-fluoroadenosine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
aacagtgttcttgctctataa

SEQ ID NO: 305 - RNA, 21 nt, synthetic construct
  source 1..21: mol_type = other RNA
  modified_base 1: mod_base = OTHER; note = 2'-deoxy-2'-fluoroadenosine-3'-phosphorothioate
  modified_base 2: mod_base = OTHER; note = 2'-O-methyladenosine-3'-phosphorothioate
  modified_base 3: mod_base = OTHER; note = 2'-deoxy-2'-fluorocytidine-3'-phosphate
  modified_base 4: mod_base = OTHER; note = 2'-O-methyladenosine-3'-phosphate
  modified_base 5: mod_base = OTHER; note = 2'-deoxy-2'-fluoroguanosine-3'-phosphate
  modified_base 6: mod_base = OTHER; note = Thymidine-glycol nucleic acid (GNA), S-Isomer
  modified_base 7: mod_base = OTHER; note = 2'-deoxy-2'-fluoroguanosine-3'-phosphate
  modified_base 8: mod_base = OTHER; note = 2'-O-methyluridine-3'-phosphate
  modified_base 9: mod_base = OTHER; note = 2'-deoxy-2'-fluorouridine-3'-phosphate
  modified_base 10: mod_base = OTHER; note = 2'-deoxy-2'-fluorocytidine-3'-phosphate
  modified_base 11: mod_base = OTHER; note = 2'-deoxy-2'-fluorouridine-3'-phosphate
  modified_base 12: mod_base = OTHER; note = 2'-O-methyluridine-3'-phosphate
  modified_base 13: mod_base = OTHER; note = 2'-deoxy-2'-fluoroguanosine-3'-phosphate
  modified_base 14: mod_base = OTHER; note = 2'-O-methylcytidine-3'-phosphate
  modified_base 15: mod_base = OTHER; note = 2'-deoxy-2'-fluorouridine-3'-phosphate
  modified_base 16: mod_base = OTHER; note = 2'-O-methylcytidine-3'-phosphate
  modified_base 17: mod_base = OTHER; note = 2'-deoxy-2'-fluorouridine-3'-phosphate
  modified_base 18: mod_base = OTHER; note = 2'-O-methyladenosine-3'-phosphate
  modified_base 19: mod_base = OTHER; note = 2'-deoxy-2'-fluorouridine-3'-phosphate
  modified_base 20: mod_base = OTHER; note = 2'-O-methyladenosine-3'-phosphate
  modified_base 21: mod_base = OTHER; note = 2'-deoxy-2'-fluoroadenosine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
aacagtgttcttgctctataa

SEQ ID NO: 306 - RNA, 21 nt, synthetic construct
  source 1..21: mol_type = other RNA
  modified_base 1: mod_base = OTHER; note = 2'-deoxy-2'-fluoroadenosine-3'-phosphorothioate
  modified_base 2: mod_base = OTHER; note = 2'-O-methyladenosine-3'-phosphorothioate
  modified_base 3: mod_base = OTHER; note = 2'-deoxy-2'-fluorocytidine-3'-phosphate
  modified_base 4: mod_base = OTHER; note = 2'-O-methyladenosine-3'-phosphate
  modified_base 5: mod_base = OTHER; note = 2'-deoxy-2'-fluoroguanosine-3'-phosphate
  modified_base 6: mod_base = OTHER; note = 2'-O-methyluridine-3'-phosphate
  modified_base 7: mod_base = OTHER; note = Guanosine-glycol nucleic acid (GNA), S-isomer
  modified_base 8: mod_base = OTHER; note = 2'-O-methyluridine-3'-phosphate
  modified_base 9: mod_base = OTHER; note = 2'-deoxy-2'-fluorouridine-3'-phosphate
  modified_base 10: mod_base = OTHER; note = 2'-deoxy-2'-fluorocytidine-3'-phosphate
  modified_base 11: mod_base = OTHER; note = 2'-deoxy-2'-fluorouridine-3'-phosphate
  modified_base 12: mod_base = OTHER; note = 2'-O-methyluridine-3'-phosphate
  modified_base 13: mod_base = OTHER; note = 2'-deoxy-2'-fluoroguanosine-3'-phosphate
  modified_base 14: mod_base = OTHER; note = 2'-O-methylcytidine-3'-phosphate
  modified_base 15: mod_base = OTHER; note = 2'-deoxy-2'-fluorouridine-3'-phosphate
  modified_base 16: mod_base = OTHER; note = 2'-O-methylcytidine-3'-phosphate
  modified_base 17: mod_base = OTHER; note = 2'-deoxy-2'-fluorouridine-3'-phosphate
  modified_base 18: mod_base = OTHER; note = 2'-O-methyladenosine-3'-phosphate
  modified_base 19: mod_base = OTHER; note = 2'-deoxy-2'-fluorouridine-3'-phosphate
  modified_base 20: mod_base = OTHER; note = 2'-O-methyladenosine-3'-phosphate
  modified_base 21: mod_base = OTHER; note = 2'-deoxy-2'-fluoroadenosine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
aacagtgttcttgctctataa

SEQ ID NO: 307 - RNA, 21 nt, synthetic construct
  source 1..21: mol_type = other RNA
  modified_base 1: mod_base = OTHER; note = 2'-deoxy-2'-fluoroadenosine-3'-phosphorothioate
  modified_base 2: mod_base = OTHER; note = 2'-O-methyladenosine-3'-phosphorothioate
  modified_base 3: mod_base = OTHER; note = 2'-deoxy-2'-fluorocytidine-3'-phosphate
  modified_base 4: mod_base = OTHER; note = 2'-O-methyladenosine-3'-phosphate
  modified_base 5: mod_base = OTHER; note = 2'-deoxy-2'-fluoroguanosine-3'-phosphate
  modified_base 6: mod_base = OTHER; note = 2'-O-methyluridine-3'-phosphate
  modified_base 7: mod_base = OTHER; note = 2'-deoxy-2'-fluoroguanosine-3'-phosphate
  modified_base 8: mod_base = OTHER; note = Thymidine-glycol nucleic acid (GNA), S-Isomer
  modified_base 9: mod_base = OTHER; note = 2'-deoxy-2'-fluorouridine-3'-phosphate
  modified_base 10: mod_base = OTHER; note = 2'-deoxy-2'-fluorocytidine-3'-phosphate
  modified_base 11: mod_base = OTHER; note = 2'-deoxy-2'-fluorouridine-3'-phosphate
  modified_base 12: mod_base = OTHER; note = 2'-O-methyluridine-3'-phosphate
  modified_base 13: mod_base = OTHER; note = 2'-deoxy-2'-fluoroguanosine-3'-phosphate
  modified_base 14: mod_base = OTHER; note = 2'-O-methylcytidine-3'-phosphate
  modified_base 15: mod_base = OTHER; note = 2'-deoxy-2'-fluorouridine-3'-phosphate
  modified_base 16: mod_base = OTHER; note = 2'-O-methylcytidine-3'-phosphate
  modified_base 17: mod_base = OTHER; note = 2'-deoxy-2'-fluorouridine-3'-phosphate
  modified_base 18: mod_base = OTHER; note = 2'-O-methyladenosine-3'-phosphate
  modified_base 19: mod_base = OTHER; note = 2'-deoxy-2'-fluorouridine-3'-phosphate
  modified_base 20: mod_base = OTHER; note = 2'-O-methyladenosine-3'-phosphate
  modified_base 21: mod_base = OTHER; note = 2'-deoxy-2'-fluoroadenosine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
aacagtgttcttgctctataa

SEQ ID NO: 308 - RNA, 21 nt, synthetic construct
  source 1..21: mol_type = other RNA
  modified_base 1: mod_base = OTHER; note = 2'-deoxy-2'-fluoroadenosine-3'-phosphorothioate
  modified_base 2: mod_base = OTHER; note = 2'-O-methyladenosine-3'-phosphorothioate
  modified_base 3: mod_base = OTHER; note = 2'-deoxy-2'-fluorocytidine-3'-phosphate
  modified_base 4: mod_base = OTHER; note = 2'-O-methyladenosine-3'-phosphate
  modified_base 5: mod_base = OTHER; note = 2'-deoxy-2'-fluoroguanosine-3'-phosphate
  modified_base 6: mod_base = OTHER; note = 2'-O-methyluridine-3'-phosphate
  modified_base 7: mod_base = OTHER; note = 2'-deoxy-2'-fluoroguanosine-3'-phosphate
  modified_base 8: mod_base = OTHER; note = 2'-O-methyluridine-3'-phosphate
  modified_base 9: mod_base = OTHER; note = Thymidine-glycol nucleic acid (GNA), S-Isomer
  modified_base 10: mod_base = OTHER; note = 2'-deoxy-2'-fluorocytidine-3'-phosphate
  modified_base 11: mod_base = OTHER; note = 2'-deoxy-2'-fluorouridine-3'-phosphate
  modified_base 12: mod_base = OTHER; note = 2'-O-methyluridine-3'-phosphate
  modified_base 13: mod_base = OTHER; note = 2'-deoxy-2'-fluoroguanosine-3'-phosphate
  modified_base 14: mod_base = OTHER; note = 2'-O-methylcytidine-3'-phosphate
  modified_base 15: mod_base = OTHER; note = 2'-deoxy-2'-fluorouridine-3'-phosphate
  modified_base 16: mod_base = OTHER; note = 2'-O-methylcytidine-3'-phosphate
  modified_base 17: mod_base = OTHER; note = 2'-deoxy-2'-fluorouridine-3'-phosphate
  modified_base 18: mod_base = OTHER; note = 2'-O-methyladenosine-3'-phosphate
  modified_base 19: mod_base = OTHER; note = 2'-deoxy-2'-fluorouridine-3'-phosphate
  modified_base 20: mod_base = OTHER; note = 2'-O-methyladenosine-3'-phosphate
  modified_base 21: mod_base = OTHER; note = 2'-deoxy-2'-fluoroadenosine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
aacagtgttcttgctctataa

SEQ ID NO: 309 - RNA, 21 nt, synthetic construct
  source 1..21: mol_type = other RNA
  modified_base 1: mod_base = OTHER; note = 2'-deoxy-2'-fluoroadenosine-3'-phosphorothioate
  modified_base 2: mod_base = OTHER; note = 2'-O-methyladenosine-3'-phosphorothioate
  modified_base 3: mod_base = OTHER; note = 2'-deoxy-2'-fluorocytidine-3'-phosphate
  modified_base 4: mod_base = OTHER; note = 2'-O-methyladenosine-3'-phosphate
  modified_base 5: mod_base = OTHER; note = 2'-deoxy-2'-fluoroguanosine-3'-phosphate
  modified_base 6: mod_base = OTHER; note = 2'-O-methyluridine-3'-phosphate
  modified_base 7: mod_base = OTHER; note = 2'-deoxy-2'-fluoroguanosine-3'-phosphate
  modified_base 8: mod_base = OTHER; note = 2'-O-methyluridine-3'-phosphate
  modified_base 9: mod_base = OTHER; note = 2'-deoxy-2'-fluorouridine-3'-phosphate
  modified_base 10: mod_base = OTHER; note = Cytidine-glycol nucleic acid (GNA), S-isomer
  modified_base 11: mod_base = OTHER; note = 2'-deoxy-2'-fluorouridine-3'-phosphate
  modified_base 12: mod_base = OTHER; note = 2'-O-methyluridine-3'-phosphate
  modified_base 13: mod_base = OTHER; note = 2'-deoxy-2'-fluoroguanosine-3'-phosphate
  modified_base 14: mod_base = OTHER; note = 2'-O-methylcytidine-3'-phosphate
  modified_base 15: mod_base = OTHER; note = 2'-deoxy-2'-fluorouridine-3'-phosphate
  modified_base 16: mod_base = OTHER; note = 2'-O-methylcytidine-3'-phosphate
  modified_base 17: mod_base = OTHER; note = 2'-deoxy-2'-fluorouridine-3'-phosphate
  modified_base 18: mod_base = OTHER; note = 2'-O-methyladenosine-3'-phosphate
  modified_base 19: mod_base = OTHER; note = 2'-deoxy-2'-fluorouridine-3'-phosphate
  modified_base 20: mod_base = OTHER; note = 2'-O-methyladenosine-3'-phosphate
  modified_base 21: mod_base = OTHER; note = 2'-deoxy-2'-fluoroadenosine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
aacagtgttcttgctctataa

SEQ ID NO: 310 - RNA, 21 nt, synthetic construct
  source 1..21: mol_type = other RNA
  modified_base 1: mod_base = OTHER; note = 2'-deoxy-2'-fluoroadenosine-3'-phosphorothioate
  modified_base 2: mod_base = OTHER; note = 2'-O-methyladenosine-3'-phosphorothioate
  modified_base 3: mod_base = OTHER; note = 2'-deoxy-2'-fluorocytidine-3'-phosphate
  modified_base 4: mod_base = OTHER; note = 2'-O-methyladenosine-3'-phosphate
  modified_base 5: mod_base = OTHER; note = 2'-deoxy-2'-fluoroguanosine-3'-phosphate
  modified_base 6: mod_base = OTHER; note = 2'-O-methyluridine-3'-phosphate
  modified_base 7: mod_base = OTHER; note = 2'-deoxy-2'-fluoroguanosine-3'-phosphate
  modified_base 8: mod_base = OTHER; note = 2'-O-methyluridine-3'-phosphate
  modified_base 9: mod_base = OTHER; note = 2'-deoxy-2'-fluorouridine-3'-phosphate
  modified_base 10: mod_base = OTHER; note = 2'-deoxy-2'-fluorocytidine-3'-phosphate
  modified_base 11: mod_base = OTHER; note = Thymidine-glycol nucleic acid (GNA), S-Isomer
  modified_base 12: mod_base = OTHER; note = 2'-O-methyluridine-3'-phosphate
  modified_base 13: mod_base = OTHER; note = 2'-deoxy-2'-fluoroguanosine-3'-phosphate
  modified_base 14: mod_base = OTHER; note = 2'-O-methylcytidine-3'-phosphate
  modified_base 15: mod_base = OTHER; note = 2'-deoxy-2'-fluorouridine-3'-phosphate
  modified_base 16: mod_base = OTHER; note = 2'-O-methylcytidine-3'-phosphate
  modified_base 17: mod_base = OTHER; note = 2'-deoxy-2'-fluorouridine-3'-phosphate
  modified_base 18: mod_base = OTHER; note = 2'-O-methyladenosine-3'-phosphate
  modified_base 19: mod_base = OTHER; note = 2'-deoxy-2'-fluorouridine-3'-phosphate
  modified_base 20: mod_base = OTHER; note = 2'-O-methyladenosine-3'-phosphate
  modified_base 21: mod_base = OTHER; note = 2'-deoxy-2'-fluoroadenosine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
aacagtgttcttgctctataa

SEQ ID NO: 311 - RNA, 21 nt, synthetic construct
  source 1..21: mol_type = other RNA
  modified_base 1: mod_base = OTHER; note = 2'-deoxy-2'-fluoroadenosine-3'-phosphorothioate
  modified_base 2: mod_base = OTHER; note = 2'-O-methyladenosine-3'-phosphorothioate
  modified_base 3: mod_base = OTHER; note = 2'-deoxy-2'-fluorocytidine-3'-phosphate
  modified_base 4: mod_base = OTHER; note = 2'-O-methyladenosine-3'-phosphate
  modified_base 5: mod_base = OTHER; note = 2'-deoxy-2'-fluoroguanosine-3'-phosphate
  modified_base 6: mod_base = OTHER; note = 2'-O-methyluridine-3'-phosphate
  modified_base 7: mod_base = OTHER; note = 2'-deoxy-2'-fluoroguanosine-3'-phosphate
  modified_base 8: mod_base = OTHER; note = 2'-O-methyluridine-3'-phosphate
  modified_base 9: mod_base = OTHER; note = 2'-deoxy-2'-fluorouridine-3'-phosphate
  modified_base 10: mod_base = OTHER; note = 2'-deoxy-2'-fluorocytidine-3'-phosphate
  modified_base 11: mod_base = OTHER; note = 2'-deoxy-2'-fluorouridine-3'-phosphate
  modified_base 12: mod_base = OTHER; note = Thymidine-glycol nucleic acid (GNA), S-Isomer
  modified_base 13: mod_base = OTHER; note = 2'-deoxy-2'-fluoroguanosine-3'-phosphate
  modified_base 14: mod_base = OTHER; note = 2'-O-methylcytidine-3'-phosphate
  modified_base 15: mod_base = OTHER; note = 2'-deoxy-2'-fluorouridine-3'-phosphate
  modified_base 16: mod_base = OTHER; note = 2'-O-methylcytidine-3'-phosphate
  modified_base 17: mod_base = OTHER; note = 2'-deoxy-2'-fluorouridine-3'-phosphate
  modified_base 18: mod_base = OTHER; note = 2'-O-methyladenosine-3'-phosphate
  modified_base 19: mod_base = OTHER; note = 2'-deoxy-2'-fluorouridine-3'-phosphate
  modified_base 20: mod_base = OTHER; note = 2'-O-methyladenosine-3'-phosphate
  modified_base 21: mod_base = OTHER; note = 2'-deoxy-2'-fluoroadenosine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
aacagtgttcttgctctataa

SEQ ID NO: 312 - RNA, 21 nt, synthetic construct
  source 1..21: mol_type = other RNA
  modified_base 1: mod_base = OTHER; note = 2'-deoxy-2'-fluoroadenosine-3'-phosphorothioate
  modified_base 2: mod_base = OTHER; note = 2'-O-methyladenosine-3'-phosphorothioate
  modified_base 3: mod_base = OTHER; note = 2'-deoxy-2'-fluorocytidine-3'-phosphate
  modified_base 4: mod_base = OTHER; note = 2'-O-methyladenosine-3'-phosphate
  modified_base 5: mod_base = OTHER; note = 2'-deoxy-2'-fluoroguanosine-3'-phosphate
  modified_base 6: mod_base = OTHER; note = 2'-O-methyluridine-3'-phosphate
  modified_base 7: mod_base = OTHER; note = 2'-deoxy-2'-fluoroguanosine-3'-phosphate
  modified_base 8: mod_base = OTHER; note = 2'-O-methyluridine-3'-phosphate
  modified_base 9: mod_base = OTHER; note = 2'-deoxy-2'-fluorouridine-3'-phosphate
  modified_base 10: mod_base = OTHER; note = 2'-deoxy-2'-fluorocytidine-3'-phosphate
  modified_base 11: mod_base = OTHER; note = 2'-deoxy-2'-fluorouridine-3'-phosphate
  modified_base 12: mod_base = OTHER; note = 2'-O-methyluridine-3'-phosphate
  modified_base 13: mod_base = OTHER; note = Guanosine-glycol nucleic acid (GNA), S-isomer
  modified_base 14: mod_base = OTHER; note = 2'-O-methylcytidine-3'-phosphate
  modified_base 15: mod_base = OTHER; note = 2'-deoxy-2'-fluorouridine-3'-phosphate
  modified_base 16: mod_base = OTHER; note = 2'-O-methylcytidine-3'-phosphate
  modified_base 17: mod_base = OTHER; note = 2'-deoxy-2'-fluorouridine-3'-phosphate
  modified_base 18: mod_base = OTHER; note = 2'-O-methyladenosine-3'-phosphate
  modified_base 19: mod_base = OTHER; note = 2'-deoxy-2'-fluorouridine-3'-phosphate
  modified_base 20: mod_base = OTHER; note = 2'-O-methyladenosine-3'-phosphate
  modified_base 21: mod_base = OTHER; note = 2'-deoxy-2'-fluoroadenosine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
aacagtgttcttgctctataa

SEQ ID NO: 313 - RNA, 21 nt, synthetic construct
  source 1..21: mol_type = other RNA
  modified_base 1: mod_base = OTHER; note = 2'-deoxy-2'-fluoroadenosine-3'-phosphorothioate
  modified_base 2: mod_base = OTHER; note = 2'-O-methyladenosine-3'-phosphorothioate
  modified_base 3: mod_base = OTHER; note = 2'-deoxy-2'-fluorocytidine-3'-phosphate
  modified_base 4: mod_base = OTHER; note = 2'-O-methyladenosine-3'-phosphate
  modified_base 5: mod_base = OTHER; note = 2'-deoxy-2'-fluoroguanosine-3'-phosphate
  modified_base 6: mod_base = OTHER; note = 2'-O-methyluridine-3'-phosphate
  modified_base 7: mod_base = OTHER; note = 2'-deoxy-2'-fluoroguanosine-3'-phosphate
  modified_base 8: mod_base = OTHER; note = 2'-O-methyluridine-3'-phosphate
  modified_base 9: mod_base = OTHER; note = 2'-deoxy-2'-fluorouridine-3'-phosphate
  modified_base 10: mod_base = OTHER; note = 2'-deoxy-2'-fluorocytidine-3'-phosphate
  modified_base 11: mod_base = OTHER; note = 2'-deoxy-2'-fluorouridine-3'-phosphate
  modified_base 12: mod_base = OTHER; note = 2'-O-methyluridine-3'-phosphate
  modified_base 13: mod_base = OTHER; note = 2'-deoxy-2'-fluoroguanosine-3'-phosphate
  modified_base 14: mod_base = OTHER; note = Cytidine-glycol nucleic acid (GNA), S-isomer
  modified_base 15: mod_base = OTHER; note = 2'-deoxy-2'-fluorouridine-3'-phosphate
  modified_base 16: mod_base = OTHER; note = 2'-O-methylcytidine-3'-phosphate
  modified_base 17: mod_base = OTHER; note = 2'-deoxy-2'-fluorouridine-3'-phosphate
  modified_base 18: mod_base = OTHER; note = 2'-O-methyladenosine-3'-phosphate
  modified_base 19: mod_base = OTHER; note = 2'-deoxy-2'-fluorouridine-3'-phosphate
  modified_base 20: mod_base = OTHER; note = 2'-O-methyladenosine-3'-phosphate
  modified_base 21: mod_base = OTHER; note = 2'-deoxy-2'-fluoroadenosine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
aacagtgttcttgctctataa

SEQ ID NO: 314 - RNA, 21 nt, synthetic construct
  source 1..21: mol_type = other RNA
  modified_base 1: mod_base = OTHER; note = 2'-deoxy-2'-fluoroadenosine-3'-phosphorothioate
  modified_base 2: mod_base = OTHER; note = 2'-O-methyladenosine-3'-phosphorothioate
  modified_base 3: mod_base = OTHER; note = 2'-deoxy-2'-fluorocytidine-3'-phosphate
  modified_base 4: mod_base = OTHER; note = 2'-O-methyladenosine-3'-phosphate
  modified_base 5: mod_base = OTHER; note = 2'-deoxy-2'-fluoroguanosine-3'-phosphate
  modified_base 6: mod_base = OTHER; note = 2'-O-methyluridine-3'-phosphate
  modified_base 7: mod_base = OTHER; note = 2'-deoxy-2'-fluoroguanosine-3'-phosphate
  modified_base 8: mod_base = OTHER; note = 2'-O-methyluridine-3'-phosphate
  modified_base 9: mod_base = OTHER; note = 2'-deoxy-2'-fluorouridine-3'-phosphate
  modified_base 10: mod_base = OTHER; note = 2'-deoxy-2'-fluorocytidine-3'-phosphate
  modified_base 11: mod_base = OTHER; note = 2'-deoxy-2'-fluorouridine-3'-phosphate
  modified_base 12: mod_base = OTHER; note = 2'-O-methyluridine-3'-phosphate
  modified_base 13: mod_base = OTHER; note = 2'-deoxy-2'-fluoroguanosine-3'-phosphate
  modified_base 14: mod_base = OTHER; note = 2'-O-methylcytidine-3'-phosphate
  modified_base 15: mod_base = OTHER; note = Thymidine-glycol nucleic acid (GNA), S-Isomer
  modified_base 16: mod_base = OTHER; note = 2'-O-methylcytidine-3'-phosphate
  modified_base 17: mod_base = OTHER; note = 2'-deoxy-2'-fluorouridine-3'-phosphate
  modified_base 18: mod_base = OTHER; note = 2'-O-methyladenosine-3'-phosphate
  modified_base 19: mod_base = OTHER; note = 2'-deoxy-2'-fluorouridine-3'-phosphate
  modified_base 20: mod_base = OTHER; note = 2'-O-methyladenosine-3'-phosphate
  modified_base 21: mod_base = OTHER; note = 2'-deoxy-2'-fluoroadenosine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
aacagtgttcttgctctataa

SEQ ID NO: 315 - RNA, 21 nt, synthetic construct
  source 1..21: mol_type = other RNA
  modified_base 1: mod_base = OTHER; note = 2'-deoxy-2'-fluoroadenosine-3'-phosphorothioate
  modified_base 2: mod_base = OTHER; note = 2'-O-methyladenosine-3'-phosphorothioate
  modified_base 3: mod_base = OTHER; note = 2'-deoxy-2'-fluorocytidine-3'-phosphate
  modified_base 4: mod_base = OTHER; note = 2'-O-methyladenosine-3'-phosphate
  modified_base 5: mod_base = OTHER; note = 2'-deoxy-2'-fluoroguanosine-3'-phosphate
  modified_base 6: mod_base = OTHER; note = 2'-O-methyluridine-3'-phosphate
  modified_base 7: mod_base = OTHER; note = 2'-deoxy-2'-fluoroguanosine-3'-phosphate
  modified_base 8: mod_base = OTHER; note = 2'-O-methyluridine-3'-phosphate
  modified_base 9: mod_base = OTHER; note = 2'-deoxy-2'-fluorouridine-3'-phosphate
  modified_base 10: mod_base = OTHER; note = 2'-deoxy-2'-fluorocytidine-3'-phosphate
  modified_base 11: mod_base = OTHER; note = 2'-deoxy-2'-fluorouridine-3'-phosphate
  modified_base 12: mod_base = OTHER; note = 2'-O-methyluridine-3'-phosphate
  modified_base 13: mod_base = OTHER; note = 2'-deoxy-2'-fluoroguanosine-3'-phosphate
  modified_base 14: mod_base = OTHER; note = 2'-O-methylcytidine-3'-phosphate
  modified_base 15: mod_base = OTHER; note = 2'-deoxy-2'-fluorouridine-3'-phosphate
  modified_base 16: mod_base = OTHER; note = Cytidine-glycol nucleic acid (GNA), S-isomer
  modified_base 17: mod_base = OTHER; note = 2'-deoxy-2'-fluorouridine-3'-phosphate
  modified_base 18: mod_base = OTHER; note = 2'-O-methyladenosine-3'-phosphate
  modified_base 19: mod_base = OTHER; note = 2'-deoxy-2'-fluorouridine-3'-phosphate
  modified_base 20: mod_base = OTHER; note = 2'-O-methyladenosine-3'-phosphate
  modified_base 21: mod_base = OTHER; note = 2'-deoxy-2'-fluoroadenosine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
aacagtgttcttgctctataa

SEQ ID NO: 316 - RNA, 21 nt, synthetic construct
  source 1..21: mol_type = other RNA
  modified_base 1: mod_base = OTHER; note = 2'-deoxy-2'-fluoroadenosine-3'-phosphorothioate
  modified_base 2: mod_base = OTHER; note = 2'-O-methyladenosine-3'-phosphorothioate
  modified_base 3: mod_base = OTHER; note = 2'-deoxy-2'-fluorocytidine-3'-phosphate
  modified_base 4: mod_base = OTHER; note = 2'-O-methyladenosine-3'-phosphate
  modified_base 5: mod_base = OTHER; note = 2'-deoxy-2'-fluoroguanosine-3'-phosphate
  modified_base 6: mod_base = OTHER; note = 2'-O-methyluridine-3'-phosphate
  modified_base 7: mod_base = OTHER; note = 2'-deoxy-2'-fluoroguanosine-3'-phosphate
  modified_base 8: mod_base = OTHER; note = 2'-O-methyluridine-3'-phosphate
  modified_base 9: mod_base = OTHER; note = 2'-deoxy-2'-fluorouridine-3'-phosphate
  modified_base 10: mod_base = OTHER; note = 2'-deoxy-2'-fluorocytidine-3'-phosphate
  modified_base 11: mod_base = OTHER; note = 2'-deoxy-2'-fluorouridine-3'-phosphate
  modified_base 12: mod_base = OTHER; note = 2'-O-methyluridine-3'-phosphate
  modified_base 13: mod_base = OTHER; note = 2'-deoxy-2'-fluoroguanosine-3'-phosphate
  modified_base 14: mod_base = OTHER; note = 2'-O-methylcytidine-3'-phosphate
  modified_base 15: mod_base = OTHER; note = 2'-deoxy-2'-fluorouridine-3'-phosphate
  modified_base 16: mod_base = OTHER; note = 2'-O-methylcytidine-3'-phosphate
  modified_base 17: mod_base = OTHER; note = Thymidine-glycol nucleic acid (GNA), S-Isomer
  modified_base 18: mod_base = OTHER; note = 2'-O-methyladenosine-3'-phosphate
  modified_base 19: mod_base = OTHER; note = 2'-deoxy-2'-fluorouridine-3'-phosphate
  modified_base 20: mod_base = OTHER; note = 2'-O-methyladenosine-3'-phosphate
  modified_base 21: mod_base = OTHER; note = 2'-deoxy-2'-fluoroadenosine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
aacagtgttcttgctctataa

SEQ ID NO: 317 - RNA, 21 nt, synthetic construct
  source 1..21: mol_type = other RNA
  modified_base 1: mod_base = OTHER; note = 2'-deoxy-2'-fluoroadenosine-3'-phosphorothioate
  modified_base 2: mod_base = OTHER; note = 2'-O-methyladenosine-3'-phosphorothioate
  modified_base 3: mod_base = OTHER; note = 2'-deoxy-2'-fluorocytidine-3'-phosphate
  modified_base 4: mod_base = OTHER; note = 2'-O-methyladenosine-3'-phosphate
  modified_base 5: mod_base = OTHER; note = 2'-deoxy-2'-fluoroguanosine-3'-phosphate
  modified_base 6: mod_base = OTHER; note = 2'-O-methyluridine-3'-phosphate
  modified_base 7: mod_base = OTHER; note = 2'-deoxy-2'-fluoroguanosine-3'-phosphate
  modified_base 8: mod_base = OTHER; note = 2'-O-methyluridine-3'-phosphate
  modified_base 9: mod_base = OTHER; note = 2'-deoxy-2'-fluorouridine-3'-phosphate
  modified_base 10: mod_base = OTHER; note = 2'-deoxy-2'-fluorocytidine-3'-phosphate
  modified_base 11: mod_base = OTHER; note = 2'-deoxy-2'-fluorouridine-3'-phosphate
  modified_base 12: mod_base = OTHER; note = 2'-O-methyluridine-3'-phosphate
  modified_base 13: mod_base = OTHER; note = 2'-deoxy-2'-fluoroguanosine-3'-phosphate
  modified_base 14: mod_base = OTHER; note = 2'-O-methylcytidine-3'-phosphate
  modified_base 15: mod_base = OTHER; note = 2'-deoxy-2'-fluorouridine-3'-phosphate
  modified_base 16: mod_base = OTHER; note = 2'-O-methylcytidine-3'-phosphate
  modified_base 17: mod_base = OTHER; note = 2'-deoxy-2'-fluorouridine-3'-phosphate
  modified_base 18: mod_base = OTHER; note = Adenosine-glycol nucleic acid (GNA), S-isomer
  modified_base 19: mod_base = OTHER; note = 2'-deoxy-2'-fluorouridine-3'-phosphate
  modified_base 20: mod_base = OTHER; note = 2'-O-methyladenosine-3'-phosphate
  modified_base 21: mod_base = OTHER; note = 2'-deoxy-2'-fluoroadenosine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
aacagtgttcttgctctataa

SEQ ID NO: 318 - RNA, 21 nt, synthetic construct
  source 1..21: mol_type = other RNA
  modified_base 1: mod_base = OTHER; note = 2'-deoxy-2'-fluoroadenosine-3'-phosphorothioate
  modified_base 2: mod_base = OTHER; note = 2'-O-methyladenosine-3'-phosphorothioate
  modified_base 3: mod_base = OTHER; note = 2'-deoxy-2'-fluorocytidine-3'-phosphate
  modified_base 4: mod_base = OTHER; note = 2'-O-methyladenosine-3'-phosphate
  modified_base 5: mod_base = OTHER; note = 2'-deoxy-2'-fluoroguanosine-3'-phosphate
  modified_base 6: mod_base = OTHER; note = 2'-O-methyluridine-3'-phosphate
  modified_base 7: mod_base = OTHER; note = 2'-deoxy-2'-fluoroguanosine-3'-phosphate
  modified_base 8: mod_base = OTHER; note = 2'-O-methyluridine-3'-phosphate
  modified_base 9: mod_base = OTHER; note = 2'-deoxy-2'-fluorouridine-3'-phosphate
  modified_base 10: mod_base = OTHER; note = 2'-deoxy-2'-fluorocytidine-3'-phosphate
  modified_base 11: mod_base = OTHER; note = 2'-deoxy-2'-fluorouridine-3'-phosphate
  modified_base 12: mod_base = OTHER; note = 2'-O-methyluridine-3'-phosphate
  modified_base 13: mod_base = OTHER; note = 2'-deoxy-2'-fluoroguanosine-3'-phosphate
  modified_base 14: mod_base = OTHER; note = 2'-O-methylcytidine-3'-phosphate
  modified_base 15: mod_base = OTHER; note = 2'-deoxy-2'-fluorouridine-3'-phosphate
  modified_base 16: mod_base = OTHER; note = 2'-O-methylcytidine-3'-phosphate
  modified_base 17: mod_base = OTHER; note = 2'-deoxy-2'-fluorouridine-3'-phosphate
  modified_base 18: mod_base = OTHER; note = 2'-O-methyladenosine-3'-phosphate
  modified_base 19: mod_base = OTHER; note = Thymidine-glycol nucleic acid (GNA), S-Isomer
  modified_base 20: mod_base = OTHER; note = 2'-O-methyladenosine-3'-phosphate
  modified_base 21: mod_base = OTHER; note = 2'-deoxy-2'-fluoroadenosine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
aacagtgttcttgctctataa

SEQ ID NO: 319 - RNA, 21 nt, synthetic construct
  source 1..21: mol_type = other RNA
  modified_base 1: mod_base = OTHER; note = 2'-deoxy-2'-fluoroadenosine-3'-phosphorothioate
  modified_base 2: mod_base = OTHER; note = 2'-O-methyladenosine-3'-phosphorothioate
  modified_base 3: mod_base = OTHER; note = 2'-deoxy-2'-fluorocytidine-3'-phosphate
  modified_base 4: mod_base = OTHER; note = 2'-O-methyladenosine-3'-phosphate
  modified_base 5: mod_base = OTHER; note = 2'-deoxy-2'-fluoroguanosine-3'-phosphate
  modified_base 6: mod_base = OTHER; note = 2'-O-methyluridine-3'-phosphate
  modified_base 7: mod_base = OTHER; note = 2'-deoxy-2'-fluoroguanosine-3'-phosphate
  modified_base 8: mod_base = OTHER; note = 2'-O-methyluridine-3'-phosphate
  modified_base 9: mod_base = OTHER; note = 2'-deoxy-2'-fluorouridine-3'-phosphate
  modified_base 10: mod_base = OTHER; note = 2'-deoxy-2'-fluorocytidine-3'-phosphate
  modified_base 11: mod_base = OTHER; note = 2'-deoxy-2'-fluorouridine-3'-phosphate
  modified_base 12: mod_base = OTHER; note = 2'-O-methyluridine-3'-phosphate
  modified_base 13: mod_base = OTHER; note = 2'-deoxy-2'-fluoroguanosine-3'-phosphate
  modified_base 14: mod_base = OTHER; note = 2'-O-methylcytidine-3'-phosphate
  modified_base 15: mod_base = OTHER; note = 2'-deoxy-2'-fluorouridine-3'-phosphate
  modified_base 16: mod_base = OTHER; note = 2'-O-methylcytidine-3'-phosphate
  modified_base 17: mod_base = OTHER; note = 2'-deoxy-2'-fluorouridine-3'-phosphate
  modified_base 18: mod_base = OTHER; note = 2'-O-methyladenosine-3'-phosphate
  modified_base 19: mod_base = OTHER; note = 2'-deoxy-2'-fluorouridine-3'-phosphate
  modified_base 20: mod_base = OTHER; note = Adenosine-glycol nucleic acid (GNA), S-isomer
  modified_base 21: mod_base = OTHER; note = 2'-deoxy-2'-fluoroadenosine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
aacagtgttcttgctctataa

SEQ ID NO: 320 - RNA, 21 nt, synthetic construct
  source 1..21: mol_type = other RNA
  modified_base 1: mod_base = OTHER; note = 2'-deoxy-2'-fluoroadenosine-3'-phosphorothioate
  modified_base 2: mod_base = OTHER; note = 2'-O-methyladenosine-3'-phosphorothioate
  modified_base 3: mod_base = OTHER; note = 2'-deoxy-2'-fluorocytidine-3'-phosphate
  modified_base 4: mod_base = OTHER; note = 2'-O-methyladenosine-3'-phosphate
  modified_base 5: mod_base = OTHER; note = 2'-deoxy-2'-fluoroguanosine-3'-phosphate
  modified_base 6: mod_base = OTHER; note = 2'-O-methyluridine-3'-phosphate
  modified_base 7: mod_base = OTHER; note = 2'-deoxy-2'-fluoroguanosine-3'-phosphate
  modified_base 8: mod_base = OTHER; note = 2'-O-methyluridine-3'-phosphate
  modified_base 9: mod_base = OTHER; note = 2'-deoxy-2'-fluorouridine-3'-phosphate
  modified_base 10: mod_base = OTHER; note = 2'-deoxy-2'-fluorocytidine-3'-phosphate
  modified_base 11: mod_base = OTHER; note = 2'-deoxy-2'-fluorouridine-3'-phosphate
  modified_base 12: mod_base = OTHER; note = 2'-O-methyluridine-3'-phosphate
  modified_base 13: mod_base = OTHER; note = 2'-deoxy-2'-fluoroguanosine-3'-phosphate
  modified_base 14: mod_base = OTHER; note = 2'-O-methylcytidine-3'-phosphate
  modified_base 15: mod_base = OTHER; note = 2'-deoxy-2'-fluorouridine-3'-phosphate
  modified_base 16: mod_base = OTHER; note = 2'-O-methylcytidine-3'-phosphate
  modified_base 17: mod_base = OTHER; note = 2'-deoxy-2'-fluorouridine-3'-phosphate
  modified_base 18: mod_base = OTHER; note = 2'-O-methyladenosine-3'-phosphate
  modified_base 19: mod_base = OTHER; note = 2'-deoxy-2'-fluorouridine-3'-phosphate
  modified_base 20: mod_base = OTHER; note = 2'-O-methyladenosine-3'-phosphate
  modified_base 21: mod_base = OTHER; note = Adenosine-glycol nucleic acid (GNA), S-isomer ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
aacagtgttcttgctctataa

SEQ ID NO: 321 - RNA, 23 nt, synthetic construct
  source 1..23: mol_type = other RNA
  modified_base 1: mod_base = OTHER; note = 2'-O-methyluridine-3'-phosphorothioate
  modified_base 2: mod_base = OTHER; note = 2'-deoxy-2'-fluorouridine-3'-phosphorothioate
  modified_base 3: mod_base = OTHER; note = 2'-O-methyladenosine-3'-phosphate
  modified_base 4: mod_base = OTHER; note = 2'-deoxy-2'-fluorouridine-3'-phosphate
  modified_base 5: mod_base = OTHER; note = 2'-O-methyladenosine-3'-phosphate
  modified_base 6: mod_base = OTHER; note = 2'-deoxy-2'-fluoroguanosine-3'-phosphate
  modified_base 7: mod_base = OTHER; note = 2'-O-methyladenosine-3'-phosphate
  modified_base 8: mod_base = OTHER; note = 2'-deoxy-2'-fluoroguanosine-3'-phosphate
  modified_base 9: mod_base = OTHER; note = 2'-O-methylcytidine-3'-phosphate
  modified_base 10: mod_base = OTHER; note = 2'-deoxy-2'-fluoroadenosine-3'-phosphate
  modified_base 11: mod_base = OTHER; note = 2'-O-methyladenosine-3'-phosphate
  modified_base 12: mod_base = OTHER; note = 2'-O-methylguanosine-3'-phosphate
  modified_base 13: mod_base = OTHER; note = 2'-O-methyladenosine-3'-phosphate
  modified_base 14: mod_base = OTHER; note = 2'-deoxy-2'-fluoroadenosine-3'-phosphate
  modified_base 15: mod_base = OTHER; note = 2'-O-methylcytidine-3'-phosphate
  modified_base 16: mod_base = OTHER; note = 2'-deoxy-2'-fluoroadenosine-3'-phosphate
  modified_base 17: mod_base = OTHER; note = 2'-O-methylcytidine-3'-phosphate
  modified_base 18: mod_base = OTHER; note = 2'-deoxy-2'-fluorouridine-3'-phosphate
  modified_base 19: mod_base = OTHER; note = 2'-O-methylguanosine-3'-phosphate
  modified_base 20: mod_base = OTHER; note = 2'-deoxy-2'-fluorouridine-3'-phosphate
  modified_base 21: mod_base = OTHER; note = 2'-O-methyluridine-3'-phosphorothioate
  modified_base 22: mod_base = OTHER; note = 2'-O-methyluridine-3'-phosphorothioate
  modified_base 23: mod_base = OTHER; note = 2'-O-methyluridine
ttatagagcaagaacactgtttt

SEQ ID NO: 322 - RNA, 23 nt, synthetic construct
  source 1..23: mol_type = other RNA
  modified_base 1: mod_base = OTHER; note = Thymidine-glycol nucleic acid (GNA), S-Isomer phosphorothioate
  modified_base 2: mod_base = OTHER; note = 2'-deoxy-2'-fluorouridine-3'-phosphorothioate
  modified_base 3: mod_base = OTHER; note = 2'-O-methyladenosine-3'-phosphate
  modified_base 4: mod_base = OTHER; note = 2'-deoxy-2'-fluorouridine-3'-phosphate
  modified_base 5: mod_base = OTHER; note = 2'-O-methyladenosine-3'-phosphate
  modified_base 6: mod_base = OTHER; note = 2'-deoxy-2'-fluoroguanosine-3'-phosphate
  modified_base 7: mod_base = OTHER; note = 2'-O-methyladenosine-3'-phosphate
  modified_base 8: mod_base = OTHER; note = 2'-deoxy-2'-fluoroguanosine-3'-phosphate
  modified_base 9: mod_base = OTHER; note = 2'-O-methylcytidine-3'-phosphate
  modified_base 10: mod_base = OTHER; note = 2'-deoxy-2'-fluoroadenosine-3'-phosphate
  modified_base 11: mod_base = OTHER; note = 2'-O-methyladenosine-3'-phosphate
  modified_base 12: mod_base = OTHER; note = 2'-O-methylguanosine-3'-phosphate
  modified_base 13: mod_base = OTHER; note = 2'-O-methyladenosine-3'-phosphate
  modified_base 14: mod_base = OTHER; note = 2'-deoxy-2'-fluoroadenosine-3'-phosphate
  modified_base 15: mod_base = OTHER; note = 2'-O-methylcytidine-3'-phosphate
  modified_base 16: mod_base = OTHER; note = 2'-deoxy-2'-fluoroadenosine-3'-phosphate
  modified_base 17: mod_base = OTHER; note = 2'-O-methylcytidine-3'-phosphate
  modified_base 18: mod_base = OTHER; note = 2'-deoxy-2'-fluorouridine-3'-phosphate
  modified_base 19: mod_base = OTHER; note = 2'-O-methylguanosine-3'-phosphate
  modified_base 20: mod_base = OTHER; note = 2'-deoxy-2'-fluorouridine-3'-phosphate
  modified_base 21: mod_base = OTHER; note = 2'-O-methyluridine-3'-phosphorothioate
  modified_base 22: mod_base = OTHER; note = 2'-O-methyluridine-3'-phosphorothioate
  modified_base 23: mod_base = OTHER; note = 2'-O-methyluridine
ttatagagcaagaacactgtttt

SEQ ID NO: 323 - RNA, 23 nt, synthetic construct
  source 1..23: mol_type = other RNA
  modified_base 1: mod_base = OTHER; note = Thymidine-glycol nucleic acid (GNA), S-Isomer phosphorothioate 5'phosphate
  modified_base 2: mod_base = OTHER; note = 2'-deoxy-2'-fluorouridine-3'-phosphorothioate
  modified_base 3: mod_base = OTHER; note = 2'-O-methyladenosine-3'-phosphate
  modified_base 4: mod_base = OTHER; note = 2'-deoxy-2'-fluorouridine-3'-phosphate
  modified_base 5: mod_base = OTHER; note = 2'-O-methyladenosine-3'-phosphate
  modified_base 6: mod_base = OTHER; note = 2'-deoxy-2'-fluoroguanosine-3'-phosphate
  modified_base 7: mod_base = OTHER; note = 2'-O-methyladenosine-3'-phosphate
  modified_base 8: mod_base = OTHER; note = 2'-deoxy-2'-fluoroguanosine-3'-phosphate
  modified_base 9: mod_base = OTHER; note = 2'-O-methylcytidine-3'-phosphate
  modified_base 10: mod_base = OTHER; note = 2'-deoxy-2'-fluoroadenosine-3'-phosphate
  modified_base 11: mod_base = OTHER; note = 2'-O-methyladenosine-3'-phosphate
  modified_base 12: mod_base = OTHER; note = 2'-O-methylguanosine-3'-phosphate
  modified_base 13: mod_base = OTHER; note = 2'-O-methyladenosine-3'-phosphate
  modified_base 14: mod_base = OTHER; note = 2'-deoxy-2'-fluoroadenosine-3'-phosphate
  modified_base 15: mod_base = OTHER; note = 2'-O-methylcytidine-3'-phosphate
  modified_base 16: mod_base = OTHER; note = 2'-deoxy-2'-fluoroadenosine-3'-phosphate
  modified_base 17: mod_base = OTHER; note = 2'-O-methylcytidine-3'-phosphate
  modified_base 18: mod_base = OTHER; note = 2'-deoxy-2'-fluorouridine-3'-phosphate
  modified_base 19: mod_base = OTHER; note = 2'-O-methylguanosine-3'-phosphate
  modified_base 20: mod_base = OTHER; note = 2'-deoxy-2'-fluorouridine-3'-phosphate
  modified_base 21: mod_base = OTHER; note = 2'-O-methyluridine-3'-phosphorothioate
  modified_base 22: mod_base = OTHER; note = 2'-O-methyluridine-3'-phosphorothioate
  modified_base 23: mod_base = OTHER; note = 2'-O-methyluridine
ttatagagcaagaacactgtttt

SEQ ID NO: 324 - RNA, 23 nt, synthetic construct
  source 1..23: mol_type = other RNA
  modified_base 1: mod_base = OTHER; note = 2'-O-methyluridine-3'-phosphorothioate
  modified_base 2: mod_base = OTHER; note = Thymidine-glycol nucleic acid (GNA), S-Isomer phosphorothioate
  modified_base 3: mod_base = OTHER; note = 2'-O-methyladenosine-3'-phosphate
  modified_base 4: mod_base = OTHER; note = 2'-deoxy-2'-fluorouridine-3'-phosphate
  modified_base 5: mod_base = OTHER; note = 2'-O-methyladenosine-3'-phosphate
  modified_base 6: mod_base = OTHER; note = 2'-deoxy-2'-fluoroguanosine-3'-phosphate
  modified_base 7: mod_base = OTHER; note = 2'-O-methyladenosine-3'-phosphate
  modified_base 8: mod_base = OTHER; note = 2'-deoxy-2'-fluoroguanosine-3'-phosphate
  modified_base 9: mod_base = OTHER; note = 2'-O-methylcytidine-3'-phosphate
  modified_base 10: mod_base = OTHER; note = 2'-deoxy-2'-fluoroadenosine-3'-phosphate
  modified_base 11: mod_base = OTHER; note = 2'-O-methyladenosine-3'-phosphate
  modified_base 12: mod_base = OTHER; note = 2'-O-methylguanosine-3'-phosphate
  modified_base 13: mod_base = OTHER; note = 2'-O-methyladenosine-3'-phosphate
  modified_base 14: mod_base = OTHER; note = 2'-deoxy-2'-fluoroadenosine-3'-phosphate
  modified_base 15: mod_base = OTHER; note = 2'-O-methylcytidine-3'-phosphate
  modified_base 16: mod_base = OTHER; note = 2'-deoxy-2'-fluoroadenosine-3'-phosphate
  modified_base 17: mod_base = OTHER; note = 2'-O-methylcytidine-3'-phosphate
  modified_base 18: mod_base = OTHER; note = 2'-deoxy-2'-fluorouridine-3'-phosphate
  modified_base 19: mod_base = OTHER; note = 2'-O-methylguanosine-3'-phosphate
  modified_base 20: mod_base = OTHER; note = 2'-deoxy-2'-fluorouridine-3'-phosphate
  modified_base 21: mod_base = OTHER; note = 2'-O-methyluridine-3'-phosphorothioate
  modified_base 22: mod_base = OTHER; note = 2'-O-methyluridine-3'-phosphorothioate
  modified_base 23: mod_base = OTHER; note = 2'-O-methyluridine
ttatagagcaagaacactgtttt

SEQ ID NO: 325 - RNA, 23 nt, synthetic construct
  source 1..23: mol_type = other RNA
  modified_base 1: mod_base = OTHER; note = 2'-O-methyluridine-3'-phosphorothioate
  modified_base 2: mod_base = OTHER; note = 2'-deoxy-2'-fluorouridine-3'-phosphorothioate
  modified_base 3: mod_base = OTHER; note = Adenosine-glycol nucleic acid (GNA), S-isomer
  modified_base 4: mod_base = OTHER; note = 2'-deoxy-2'-fluorouridine-3'-phosphate
  modified_base 5: mod_base = OTHER; note = 2'-O-methyladenosine-3'-phosphate
  modified_base 6: mod_base = OTHER; note = 2'-deoxy-2'-fluoroguanosine-3'-phosphate
  modified_base 7: mod_base = OTHER; note = 2'-O-methyladenosine-3'-phosphate
  modified_base 8: mod_base = OTHER; note = 2'-deoxy-2'-fluoroguanosine-3'-phosphate
  modified_base 9: mod_base = OTHER; note = 2'-O-methylcytidine-3'-phosphate
  modified_base 10: mod_base = OTHER; note = 2'-deoxy-2'-fluoroadenosine-3'-phosphate
  modified_base 11: mod_base = OTHER; note = 2'-O-methyladenosine-3'-phosphate
  modified_base 12: mod_base = OTHER; note = 2'-O-methylguanosine-3'-phosphate
  modified_base 13: mod_base = OTHER; note = 2'-O-methyladenosine-3'-phosphate
  modified_base 14: mod_base = OTHER; note = 2'-deoxy-2'-fluoroadenosine-3'-phosphate
  modified_base 15: mod_base = OTHER; note = 2'-O-methylcytidine-3'-phosphate
  modified_base 16: mod_base = OTHER; note = 2'-deoxy-2'-fluoroadenosine-3'-phosphate
  modified_base 17: mod_base = OTHER; note = 2'-O-methylcytidine-3'-phosphate
  modified_base 18: mod_base = OTHER; note = 2'-deoxy-2'-fluorouridine-3'-phosphate
  modified_base 19: mod_base = OTHER; note = 2'-O-methylguanosine-3'-phosphate
  modified_base 20: mod_base = OTHER; note = 2'-deoxy-2'-fluorouridine-3'-phosphate
  modified_base 21: mod_base = OTHER; note = 2'-O-methyluridine-3'-phosphorothioate
  modified_base 22: mod_base = OTHER; note = 2'-O-methyluridine-3'-phosphorothioate
  modified_base 23: mod_base = OTHER; note = 2'-O-methyluridine
ttatagagcaagaacactgtttt

SEQ ID NO: 326 - RNA, 23 nt, synthetic construct
  source 1..23: mol_type = other RNA
  modified_base 1: mod_base = OTHER; note = 2'-O-methyluridine-3'-phosphorothioate
  modified_base 2: mod_base = OTHER; note = 2'-deoxy-2'-fluorouridine-3'-phosphorothioate
  modified_base 3: mod_base = OTHER; note = 2'-O-methyladenosine-3'-phosphate
  modified_base 4: mod_base = OTHER; note = Thymidine-glycol nucleic acid (GNA), S-Isomer
  modified_base 5: mod_base = OTHER; note = 2'-O-methyladenosine-3'-phosphate
  modified_base 6: mod_base = OTHER; note = 2'-deoxy-2'-fluoroguanosine-3'-phosphate
  modified_base 7: mod_base = OTHER; note = 2'-O-methyladenosine-3'-phosphate
  modified_base 8: mod_base = OTHER; note = 2'-deoxy-2'-fluoroguanosine-3'-phosphate
  modified_base 9: mod_base = OTHER; note = 2'-O-methylcytidine-3'-phosphate
  modified_base 10: mod_base = OTHER; note = 2'-deoxy-2'-fluoroadenosine-3'-phosphate
  modified_base 11: mod_base = OTHER; note = 2'-O-methyladenosine-3'-phosphate
  modified_base 12: mod_base = OTHER; note = 2'-O-methylguanosine-3'-phosphate
  modified_base 13: mod_base = OTHER; note = 2'-O-methyladenosine-3'-phosphate
  modified_base 14: mod_base = OTHER; note = 2'-deoxy-2'-fluoroadenosine-3'-phosphate
  modified_base 15: mod_base = OTHER; note = 2'-O-methylcytidine-3'-phosphate
  modified_base 16: mod_base = OTHER; note = 2'-deoxy-2'-fluoroadenosine-3'-phosphate
  modified_base 17: mod_base = OTHER; note = 2'-O-methylcytidine-3'-phosphate
  modified_base 18: mod_base = OTHER; note = 2'-deoxy-2'-fluorouridine-3'-phosphate
  modified_base 19: mod_base = OTHER; note = 2'-O-methylguanosine-3'-phosphate
  modified_base 20: mod_base = OTHER; note = 2'-deoxy-2'-fluorouridine-3'-phosphate
  modified_base 21: mod_base = OTHER; note = 2'-O-methyluridine-3'-phosphorothioate
  modified_base 22: mod_base = OTHER; note = 2'-O-methyluridine-3'-phosphorothioate
  modified_base 23: mod_base = OTHER; note = 2'-O-methyluridine
ttatagagcaagaacactgtttt

SEQ ID NO: 327 - RNA, 23 nt, synthetic construct
  source 1..23: mol_type = other RNA
  modified_base 1: mod_base = OTHER; note = 2'-O-methyluridine-3'-phosphorothioate
  modified_base 2: mod_base = OTHER; note = 2'-deoxy-2'-fluorouridine-3'-phosphorothioate
  modified_base 3: mod_base = OTHER; note = 2'-O-methyladenosine-3'-phosphate
  modified_base 4: mod_base = OTHER; note = 2'-deoxy-2'-fluorouridine-3'-phosphate
  modified_base 5: mod_base = OTHER; note = Adenosine-glycol nucleic acid (GNA), S-isomer
  modified_base 6: mod_base = OTHER; note = 2'-deoxy-2'-fluoroguanosine-3'-phosphate
  modified_base 7: mod_base = OTHER; note = 2'-O-methyladenosine-3'-phosphate
  modified_base 8: mod_base = OTHER; note = 2'-deoxy-2'-fluoroguanosine-3'-phosphate
  modified_base 9: mod_base = OTHER; note = 2'-O-methylcytidine-3'-phosphate
  modified_base 10: mod_base = OTHER; note = 2'-deoxy-2'-fluoroadenosine-3'-phosphate
  modified_base 11: mod_base = OTHER; note = 2'-O-methyladenosine-3'-phosphate
  modified_base 12: mod_base = OTHER; note = 2'-O-methylguanosine-3'-phosphate
  modified_base 13: mod_base = OTHER; note = 2'-O-methyladenosine-3'-phosphate
  modified_base 14: mod_base = OTHER; note = 2'-deoxy-2'-fluoroadenosine-3'-phosphate
  modified_base 15: mod_base = OTHER; note = 2'-O-methylcytidine-3'-phosphate
  modified_base 16: mod_base = OTHER; note = 2'-deoxy-2'-fluoroadenosine-3'-phosphate
  modified_base 17: mod_base = OTHER; note = 2'-O-methylcytidine-3'-phosphate
  modified_base 18: mod_base = OTHER; note = 2'-deoxy-2'-fluorouridine-3'-phosphate
  modified_base 19: mod_base = OTHER; note = 2'-O-methylguanosine-3'-phosphate
  modified_base 20: mod_base = OTHER; note = 2'-deoxy-2'-fluorouridine-3'-phosphate
  modified_base 21: mod_base = OTHER; note = 2'-O-methyluridine-3'-phosphorothioate
  modified_base 22: mod_base = OTHER; note = 2'-O-methyluridine-3'-phosphorothioate
  modified_base 23: mod_base = OTHER; note = 2'-O-methyluridine
ttatagagcaagaacactgtttt

SEQ ID NO: 328 - RNA, 23 nt, synthetic construct
  source 1..23: mol_type = other RNA
  modified_base 1: mod_base = OTHER; note = 2'-O-methyluridine-3'-phosphorothioate
  modified_base 2: mod_base = OTHER; note = 2'-deoxy-2'-fluorouridine-3'-phosphorothioate
  modified_base 3: mod_base = OTHER; note = 2'-O-methyladenosine-3'-phosphate
  modified_base 4: mod_base = OTHER; note = 2'-deoxy-2'-fluorouridine-3'-phosphate
  modified_base 5: mod_base = OTHER; note = 2'-O-methyladenosine-3'-phosphate
  modified_base 6: mod_base = OTHER; note = Guanosine-glycol nucleic acid (GNA), S-isomer
  modified_base 7: mod_base = OTHER; note = 2'-O-methyladenosine-3'-phosphate
  modified_base 8: mod_base = OTHER; note = 2'-deoxy-2'-fluoroguanosine-3'-phosphate
  modified_base 9: mod_base = OTHER; note = 2'-O-methylcytidine-3'-phosphate
  modified_base 10: mod_base = OTHER; note = 2'-deoxy-2'-fluoroadenosine-3'-phosphate
  modified_base 11: mod_base = OTHER; note = 2'-O-methyladenosine-3'-phosphate
  modified_base 12: mod_base = OTHER; note = 2'-O-methylguanosine-3'-phosphate
  modified_base 13: mod_base = OTHER; note = 2'-O-methyladenosine-3'-phosphate
  modified_base 14: mod_base = OTHER; note = 2'-deoxy-2'-fluoroadenosine-3'-phosphate
  modified_base 15: mod_base = OTHER; note = 2'-O-methylcytidine-3'-phosphate
  modified_base 16: mod_base = OTHER; note = 2'-deoxy-2'-fluoroadenosine-3'-phosphate
  modified_base 17: mod_base = OTHER; note = 2'-O-methylcytidine-3'-phosphate
  modified_base 18: mod_base = OTHER; note = 2'-deoxy-2'-fluorouridine-3'-phosphate
  modified_base 19: mod_base = OTHER; note = 2'-O-methylguanosine-3'-phosphate
  modified_base 20: mod_base = OTHER; note = 2'-deoxy-2'-fluorouridine-3'-phosphate
  modified_base 21: mod_base = OTHER; note = 2'-O-methyluridine-3'-phosphorothioate
  modified_base 22: mod_base = OTHER; note = 2'-O-methyluridine-3'-phosphorothioate
  modified_base 23: mod_base = OTHER; note = 2'-O-methyluridine
ttatagagcaagaacactgtttt

SEQ ID NO: 329 - RNA, 23 nt, synthetic construct
  source 1..23: mol_type = other RNA
  modified_base 1: mod_base = OTHER; note = 2'-O-methyluridine-3'-phosphorothioate
  modified_base 2: mod_base = OTHER; note = 2'-deoxy-2'-fluorouridine-3'-phosphorothioate
  modified_base 3: mod_base = OTHER; note = 2'-O-methyladenosine-3'-phosphate
  modified_base 4: mod_base = OTHER; note = 2'-deoxy-2'-fluorouridine-3'-phosphate
  modified_base 5: mod_base = OTHER; note = 2'-O-methyladenosine-3'-phosphate
  modified_base 6: mod_base = OTHER; note = 2'-deoxy-2'-fluoroguanosine-3'-phosphate
  modified_base 7: mod_base = OTHER; note = Adenosine-glycol nucleic acid (GNA), S-isomer
  modified_base 8: mod_base = OTHER; note = 2'-deoxy-2'-fluoroguanosine-3'-phosphate
  modified_base 9: mod_base = OTHER; note = 2'-O-methylcytidine-3'-phosphate
  modified_base 10: mod_base = OTHER; note = 2'-deoxy-2'-fluoroadenosine-3'-phosphate
  modified_base 11: mod_base = OTHER; note = 2'-O-methyladenosine-3'-phosphate
  modified_base 12: mod_base = OTHER; note = 2'-O-methylguanosine-3'-phosphate
  modified_base 13: mod_base = OTHER; note = 2'-O-methyladenosine-3'-phosphate
  modified_base 14: mod_base = OTHER; note = 2'-deoxy-2'-fluoroadenosine-3'-phosphate
  modified_base 15: mod_base = OTHER; note = 2'-O-methylcytidine-3'-phosphate
  modified_base 16: mod_base = OTHER; note = 2'-deoxy-2'-fluoroadenosine-3'-phosphate
  modified_base 17: mod_base = OTHER; note = 2'-O-methylcytidine-3'-phosphate
  modified_base 18: mod_base = OTHER; note = 2'-deoxy-2'-fluorouridine-3'-phosphate
  modified_base 19: mod_base = OTHER; note = 2'-O-methylguanosine-3'-phosphate
  modified_base 20: mod_base = OTHER; note = 2'-deoxy-2'-fluorouridine-3'-phosphate
  modified_base 21: mod_base = OTHER; note = 2'-O-methyluridine-3'-phosphorothioate
  modified_base 22: mod_base = OTHER; note = 2'-O-methyluridine-3'-phosphorothioate
  modified_base 23: mod_base = OTHER; note = 2'-O-methyluridine
ttatagagcaagaacactgtttt

SEQ ID NO: 330 - RNA, 23 nt, synthetic construct
  source 1..23: mol_type = other RNA
  modified_base 1: mod_base = OTHER; note = 2'-O-methyluridine-3'-phosphorothioate
  modified_base 2: mod_base = OTHER; note = 2'-deoxy-2'-fluorouridine-3'-phosphorothioate
  modified_base 3: mod_base = OTHER; note = 2'-O-methyladenosine-3'-phosphate
  modified_base 4: mod_base = OTHER; note = 2'-deoxy-2'-fluorouridine-3'-phosphate
  modified_base 5: mod_base = OTHER; note = 2'-O-methyladenosine-3'-phosphate
  modified_base 6: mod_base = OTHER; note = 2'-deoxy-2'-fluoroguanosine-3'-phosphate
  modified_base 7: mod_base = OTHER; note = 2'-O-methyladenosine-3'-phosphate
  modified_base 8: mod_base = OTHER; note = Guanosine-glycol nucleic acid (GNA), S-isomer
  modified_base 9: mod_base = OTHER; note = 2'-O-methylcytidine-3'-phosphate
  modified_base 10: mod_base = OTHER; note = 2'-deoxy-2'-fluoroadenosine-3'-phosphate
  modified_base 11: mod_base = OTHER; note = 2'-O-methyladenosine-3'-phosphate
  modified_base 12: mod_base = OTHER; note = 2'-O-methylguanosine-3'-phosphate
  modified_base 13: mod_base = OTHER; note = 2'-O-methyladenosine-3'-phosphate
  modified_base 14: mod_base = OTHER; note = 2'-deoxy-2'-fluoroadenosine-3'-phosphate
  modified_base 15: mod_base = OTHER; note = 2'-O-methylcytidine-3'-phosphate
  modified_base 16: mod_base = OTHER; note = 2'-deoxy-2'-fluoroadenosine-3'-phosphate
  modified_base 17: mod_base = OTHER; note = 2'-O-methylcytidine-3'-phosphate
  modified_base 18: mod_base = OTHER; note = 2'-deoxy-2'-fluorouridine-3'-phosphate
  modified_base 19: mod_base = OTHER; note = 2'-O-methylguanosine-3'-phosphate
  modified_base 20: mod_base = OTHER; note = 2'-deoxy-2'-fluorouridine-3'-phosphate
  modified_base 21: mod_base = OTHER; note = 2'-O-methyluridine-3'-phosphorothioate
  modified_base 22: mod_base = OTHER; note = 2'-O-methyluridine-3'-phosphorothioate
  modified_base 23: mod_base = OTHER; note = 2'-O-methyluridine
ttatagagcaagaacactgtttt

SEQ ID NO: 331 - RNA, 23 nt, synthetic construct
  source 1..23: mol_type = other RNA
  modified_base 1: mod_base = OTHER; note = 2'-O-methyluridine-3'-phosphorothioate
  modified_base 2: mod_base = OTHER; note = 2'-deoxy-2'-fluorouridine-3'-phosphorothioate
  modified_base 3: mod_base = OTHER; note = 2'-O-methyladenosine-3'-phosphate
  modified_base 4: mod_base = OTHER; note = 2'-deoxy-2'-fluorouridine-3'-phosphate
  modified_base 5: mod_base = OTHER; note = 2'-O-methyladenosine-3'-phosphate
  modified_base 6: mod_base = OTHER; note = 2'-deoxy-2'-fluoroguanosine-3'-phosphate
  modified_base 7: mod_base = OTHER; note = 2'-O-methyladenosine-3'-phosphate
  modified_base 8: mod_base = OTHER; note = 2'-deoxy-2'-fluoroguanosine-3'-phosphate
  modified_base 9: mod_base = OTHER; note = Cytidine-glycol nucleic acid (GNA), S-isomer
  modified_base 10: mod_base = OTHER; note = 2'-deoxy-2'-fluoroadenosine-3'-phosphate
  modified_base 11: mod_base = OTHER; note = 2'-O-methyladenosine-3'-phosphate
  modified_base 12: mod_base = OTHER; note = 2'-O-methylguanosine-3'-phosphate
  modified_base 13: mod_base = OTHER; note = 2'-O-methyladenosine-3'-phosphate
  modified_base 14: mod_base = OTHER; note = 2'-deoxy-2'-fluoroadenosine-3'-phosphate
  modified_base 15: mod_base = OTHER; note = 2'-O-methylcytidine-3'-phosphate
  modified_base 16: mod_base = OTHER; note = 2'-deoxy-2'-fluoroadenosine-3'-phosphate
  modified_base 17: mod_base = OTHER; note = 2'-O-methylcytidine-3'-phosphate
  modified_base 18: mod_base = OTHER; note = 2'-deoxy-2'-fluorouridine-3'-phosphate
  modified_base 19: mod_base = OTHER; note = 2'-O-methylguanosine-3'-phosphate
  modified_base 20: mod_base = OTHER; note = 2'-deoxy-2'-fluorouridine-3'-phosphate
  modified_base 21: mod_base = OTHER; note = 2'-O-methyluridine-3'-phosphorothioate
  modified_base 22: mod_base = OTHER; note = 2'-O-methyluridine-3'-phosphorothioate
  modified_base 23: mod_base = OTHER; note = 2'-O-methyluridine
ttatagagcaagaacactgtttt

SEQ ID NO: 332 - RNA, 23 nt, synthetic construct
  source 1..23: mol_type = other RNA
  modified_base 1: mod_base = OTHER; note = 2'-O-methyluridine-3'-phosphorothioate
  modified_base 2: mod_base = OTHER; note = 2'-deoxy-2'-fluorouridine-3'-phosphorothioate
  modified_base 3: mod_base = OTHER; note = 2'-O-methyladenosine-3'-phosphate
  modified_base 4: mod_base = OTHER; note = 2'-deoxy-2'-fluorouridine-3'-phosphate
  modified_base 5: mod_base = OTHER; note = 2'-O-methyladenosine-3'-phosphate
  modified_base 6: mod_base = OTHER; note = 2'-deoxy-2'-fluoroguanosine-3'-phosphate
  modified_base 7: mod_base = OTHER; note = 2'-O-methyladenosine-3'-phosphate
  modified_base 8: mod_base = OTHER; note = 2'-deoxy-2'-fluoroguanosine-3'-phosphate
  modified_base 9: mod_base = OTHER; note = 2'-O-methylcytidine-3'-phosphate
  modified_base 10: mod_base = OTHER; note = Adenosine-glycol nucleic acid (GNA), S-isomer
  modified_base 11: mod_base = OTHER; note = 2'-O-methyladenosine-3'-phosphate
  modified_base 12: mod_base = OTHER; note = 2'-O-methylguanosine-3'-phosphate
  modified_base 13: mod_base = OTHER; note = 2'-O-methyladenosine-3'-phosphate
  modified_base 14: mod_base = OTHER; note = 2'-deoxy-2'-fluoroadenosine-3'-phosphate
  modified_base 15: mod_base = OTHER; note = 2'-O-methylcytidine-3'-phosphate
  modified_base 16: mod_base = OTHER; note = 2'-deoxy-2'-fluoroadenosine-3'-phosphate
  modified_base 17: mod_base = OTHER; note = 2'-O-methylcytidine-3'-phosphate
  modified_base 18: mod_base = OTHER; note = 2'-deoxy-2'-fluorouridine-3'-phosphate
  modified_base 19: mod_base = OTHER; note = 2'-O-methylguanosine-3'-phosphate
  modified_base 20: mod_base = OTHER; note = 2'-deoxy-2'-fluorouridine-3'-phosphate
  modified_base 21: mod_base = OTHER; note = 2'-O-methyluridine-3'-phosphorothioate
  modified_base 22: mod_base = OTHER; note = 2'-O-methyluridine-3'-phosphorothioate
  modified_base 23: mod_base = OTHER; note = 2'-O-methyluridine
ttatagagcaagaacactgtttt

SEQ ID NO: 333 - RNA, 23 nt, synthetic construct
  source 1..23: mol_type = other RNA
  modified_base 1: mod_base = OTHER; note = 2'-O-methyluridine-3'-phosphorothioate
  modified_base 2: mod_base = OTHER; note = 2'-deoxy-2'-fluorouridine-3'-phosphorothioate
  modified_base 3: mod_base = OTHER; note = 2'-O-methyladenosine-3'-phosphate
  modified_base 4: mod_base = OTHER; note = 2'-deoxy-2'-fluorouridine-3'-phosphate
  modified_base 5: mod_base = OTHER; note = 2'-O-methyladenosine-3'-phosphate
  modified_base 6: mod_base = OTHER; note = 2'-deoxy-2'-fluoroguanosine-3'-phosphate
  modified_base 7: mod_base = OTHER; note = 2'-O-methyladenosine-3'-phosphate
  modified_base 8: mod_base = OTHER; note = 2'-deoxy-2'-fluoroguanosine-3'-phosphate
  modified_base 9: mod_base = OTHER; note = 2'-O-methylcytidine-3'-phosphate
  modified_base 10: mod_base = OTHER; note = 2'-deoxy-2'-fluoroadenosine-3'-phosphate
  modified_base 11: mod_base = OTHER; note = Adenosine-glycol nucleic acid (GNA), S-isomer
  modified_base 12: mod_base = OTHER; note = 2'-O-methylguanosine-3'-phosphate
  modified_base 13: mod_base = OTHER; note = 2'-O-methyladenosine-3'-phosphate
  modified_base 14: mod_base = OTHER; note = 2'-deoxy-2'-fluoroadenosine-3'-phosphate
  modified_base 15: mod_base = OTHER; note = 2'-O-methylcytidine-3'-phosphate
  modified_base 16: mod_base = OTHER; note = 2'-deoxy-2'-fluoroadenosine-3'-phosphate
  modified_base 17: mod_base = OTHER; note = 2'-O-methylcytidine-3'-phosphate
  modified_base 18: mod_base = OTHER; note = 2'-deoxy-2'-fluorouridine-3'-phosphate
  modified_base 19: mod_base = OTHER; note = 2'-O-methylguanosine-3'-phosphate
  modified_base 20: mod_base = OTHER; note = 2'-deoxy-2'-fluorouridine-3'-phosphate
  modified_base 21: mod_base = OTHER; note = 2'-O-methyluridine-3'-phosphorothioate
  modified_base 22: mod_base = OTHER; note = 2'-O-methyluridine-3'-phosphorothioate
  modified_base 23: mod_base = OTHER; note = 2'-O-methyluridine
ttatagagcaagaacactgtttt

SEQ ID NO: 334 - RNA, 23 nt, synthetic construct
  source 1..23: mol_type = other RNA
  modified_base 1: mod_base = OTHER; note = 2'-O-methyluridine-3'-phosphorothioate
  modified_base 2: mod_base = OTHER; note = 2'-deoxy-2'-fluorouridine-3'-phosphorothioate
  modified_base 3: mod_base = OTHER; note = 2'-O-methyladenosine-3'-phosphate
  modified_base 4: mod_base = OTHER; note = 2'-deoxy-2'-fluorouridine-3'-phosphate
  modified_base 5: mod_base = OTHER; note = 2'-O-methyladenosine-3'-phosphate
  modified_base 6: mod_base = OTHER; note = 2'-deoxy-2'-fluoroguanosine-3'-phosphate
  modified_base 7: mod_base = OTHER; note = 2'-O-methyladenosine-3'-phosphate
  modified_base 8: mod_base = OTHER; note = 2'-deoxy-2'-fluoroguanosine-3'-phosphate
  modified_base 9: mod_base = OTHER; note = 2'-O-methylcytidine-3'-phosphate
  modified_base 10: mod_base = OTHER; note = 2'-deoxy-2'-fluoroadenosine-3'-phosphate
  modified_base 11: mod_base = OTHER; note = 2'-O-methyladenosine-3'-phosphate
  modified_base 12: mod_base = OTHER; note = Guanosine-glycol nucleic acid (GNA), S-isomer
  modified_base 13: mod_base = OTHER; note = 2'-O-methyladenosine-3'-phosphate
  modified_base 14: mod_base = OTHER; note = 2'-deoxy-2'-fluoroadenosine-3'-phosphate
  modified_base 15: mod_base = OTHER; note = 2'-O-methylcytidine-3'-phosphate
  modified_base 16: mod_base = OTHER; note = 2'-deoxy-2'-fluoroadenosine-3'-phosphate
  modified_base 17: mod_base = OTHER; note = 2'-O-methylcytidine-3'-phosphate
  modified_base 18: mod_base = OTHER; note = 2'-deoxy-2'-fluorouridine-3'-phosphate
  modified_base 19: mod_base = OTHER; note = 2'-O-methylguanosine-3'-phosphate
  modified_base 20: mod_base = OTHER; note = 2'-deoxy-2'-fluorouridine-3'-phosphate
  modified_base 21: mod_base = OTHER; note = 2'-O-methyluridine-3'-phosphorothioate
  modified_base 22: mod_base = OTHER; note = 2'-O-methyluridine-3'-phosphorothioate
  modified_base 23: mod_base = OTHER; note = 2'-O-methyluridine
ttatagagcaagaacactgtttt

SEQ ID NO: 335 - RNA, 23 nt, synthetic construct
  source 1..23: mol_type = other RNA
  modified_base 1: mod_base = OTHER; note = 2'-O-methyluridine-3'-phosphorothioate
  modified_base 2: mod_base = OTHER; note = 2'-deoxy-2'-fluorouridine-3'-phosphorothioate
  modified_base 3: mod_base = OTHER; note = 2'-O-methyladenosine-3'-phosphate
  modified_base 4: mod_base = OTHER; note = 2'-deoxy-2'-fluorouridine-3'-phosphate
  modified_base 5: mod_base = OTHER; note = 2'-O-methyladenosine-3'-phosphate
  modified_base 6: mod_base = OTHER; note = 2'-deoxy-2'-fluoroguanosine-3'-phosphate
  modified_base 7: mod_base = OTHER; note = 2'-O-methyladenosine-3'-phosphate
  modified_base 8: mod_base = OTHER; note = 2'-deoxy-2'-fluoroguanosine-3'-phosphate
  modified_base 9: mod_base = OTHER; note = 2'-O-methylcytidine-3'-phosphate
  modified_base 10: mod_base = OTHER; note = 2'-deoxy-2'-fluoroadenosine-3'-phosphate
  modified_base 11: mod_base = OTHER; note = 2'-O-methyladenosine-3'-phosphate
  modified_base 12: mod_base = OTHER; note = 2'-O-methylguanosine-3'-phosphate
  modified_base 13: mod_base = OTHER; note = Adenosine-glycol nucleic acid (GNA), S-isomer
  modified_base 14: mod_base = OTHER; note = 2'-deoxy-2'-fluoroadenosine-3'-phosphate
  modified_base 15: mod_base = OTHER; note = 2'-O-methylcytidine-3'-phosphate
  modified_base 16: mod_base = OTHER; note = 2'-deoxy-2'-fluoroadenosine-3'-phosphate
  modified_base 17: mod_base = OTHER; note = 2'-O-methylcytidine-3'-phosphate
  modified_base 18: mod_base = OTHER; note = 2'-deoxy-2'-fluorouridine-3'-phosphate
  modified_base 19: mod_base = OTHER; note = 2'-O-methylguanosine-3'-phosphate
  modified_base 20: mod_base = OTHER; note = 2'-deoxy-2'-fluorouridine-3'-phosphate
  modified_base 21: mod_base = OTHER; note = 2'-O-methyluridine-3'-phosphorothioate
  modified_base 22: mod_base = OTHER; note = 2'-O-methyluridine-3'-phosphorothioate
  modified_base 23: mod_base = OTHER; note = 2'-O-methyluridine
ttatagagcaagaacactgtttt

SEQ ID NO: 336 - RNA, 23 nt, synthetic construct
  source 1..23: mol_type = other RNA
  modified_base 1: mod_base = OTHER; note = 2'-O-methyluridine-3'-phosphorothioate
  modified_base 2: mod_base = OTHER; note = 2'-deoxy-2'-fluorouridine-3'-phosphorothioate
  modified_base 3: mod_base = OTHER; note = 2'-O-methyladenosine-3'-phosphate
  modified_base 4: mod_base = OTHER; note = 2'-deoxy-2'-fluorouridine-3'-phosphate
  modified_base 5: mod_base = OTHER; note = 2'-O-methyladenosine-3'-phosphate
  modified_base 6: mod_base = OTHER; note = 2'-deoxy-2'-fluoroguanosine-3'-phosphate
  modified_base 7: mod_base = OTHER; note = 2'-O-methyladenosine-3'-phosphate
  modified_base 8: mod_base = OTHER; note = 2'-deoxy-2'-fluoroguanosine-3'-phosphate
  modified_base 9: mod_base = OTHER; note = 2'-O-methylcytidine-3'-phosphate
  modified_base 10: mod_base = OTHER; note = 2'-deoxy-2'-fluoroadenosine-3'-phosphate
  modified_base 11: mod_base = OTHER; note = 2'-O-methyladenosine-3'-phosphate
  modified_base 12: mod_base = OTHER; note = 2'-O-methylguanosine-3'-phosphate
  modified_base 13: mod_base = OTHER; note = 2'-O-methyladenosine-3'-phosphate
  modified_base 14: mod_base = OTHER; note = Adenosine-glycol nucleic acid (GNA), S-isomer
  modified_base 15: mod_base = OTHER; note = 2'-O-methylcytidine-3'-phosphate
  modified_base 16: mod_base = OTHER; note = 2'-deoxy-2'-fluoroadenosine-3'-phosphate
  modified_base 17: mod_base = OTHER; note = 2'-O-methylcytidine-3'-phosphate
  modified_base 18: mod_base = OTHER; note = 2'-deoxy-2'-fluorouridine-3'-phosphate
  modified_base 19: mod_base = OTHER; note = 2'-O-methylguanosine-3'-phosphate
  modified_base 20: mod_base = OTHER; note = 2'-deoxy-2'-fluorouridine-3'-phosphate
  modified_base 21: mod_base = OTHER; note = 2'-O-methyluridine-3'-phosphorothioate
  modified_base 22: mod_base = OTHER; note = 2'-O-methyluridine-3'-phosphorothioate
  modified_base 23: mod_base = OTHER; note = 2'-O-methyluridine
ttatagagcaagaacactgtttt

SEQ ID NO: 337 - RNA, 23 nt, synthetic construct
  source 1..23: mol_type = other RNA
  modified_base 1: mod_base = OTHER; note = 2'-O-methyluridine-3'-phosphorothioate
  modified_base 2: mod_base = OTHER; note = 2'-deoxy-2'-fluorouridine-3'-phosphorothioate
  modified_base 3: mod_base = OTHER; note = 2'-O-methyladenosine-3'-phosphate
  modified_base 4: mod_base = OTHER; note = 2'-deoxy-2'-fluorouridine-3'-phosphate
  modified_base 5: mod_base = OTHER; note = 2'-O-methyladenosine-3'-phosphate
  modified_base 6: mod_base = OTHER; note = 2'-deoxy-2'-fluoroguanosine-3'-phosphate
  modified_base 7: mod_base = OTHER; note = 2'-O-methyladenosine-3'-phosphate
  modified_base 8: mod_base = OTHER; note = 2'-deoxy-2'-fluoroguanosine-3'-phosphate
  modified_base 9: mod_base = OTHER; note = 2'-O-methylcytidine-3'-phosphate
  modified_base 10: mod_base = OTHER; note = 2'-deoxy-2'-fluoroadenosine-3'-phosphate
  modified_base 11: mod_base = OTHER; note = 2'-O-methyladenosine-3'-phosphate
  modified_base 12: mod_base = OTHER; note = 2'-O-methylguanosine-3'-phosphate
  modified_base 13: mod_base = OTHER; note = 2'-O-methyladenosine-3'-phosphate
  modified_base 14: mod_base = OTHER; note = 2'-deoxy-2'-fluoroadenosine-3'-phosphate
  modified_base 15: mod_base = OTHER; note = Cytidine-glycol nucleic acid (GNA), S-isomer
  modified_base 16: mod_base = OTHER; note = 2'-deoxy-2'-fluoroadenosine-3'-phosphate
  modified_base 17: mod_base = OTHER; note = 2'-O-methylcytidine-3'-phosphate
  modified_base 18: mod_base = OTHER; note = 2'-deoxy-2'-fluorouridine-3'-phosphate
  modified_base 19: mod_base = OTHER; note = 2'-O-methylguanosine-3'-phosphate
  modified_base 20: mod_base = OTHER; note = 2'-deoxy-2'-fluorouridine-3'-phosphate
  modified_base 21: mod_base = OTHER; note = 2'-O-methyluridine-3'-phosphorothioate
  modified_base 22: mod_base = OTHER; note = 2'-O-methyluridine-3'-phosphorothioate
  modified_base 23: mod_base = OTHER; note = 2'-O-methyluridine
ttatagagcaagaacactgtttt

SEQ ID NO: 338 - RNA, 23 nt, synthetic construct
  source 1..23: mol_type = other RNA
  modified_base 1: mod_base = OTHER; note = 2'-O-methyluridine-3'-phosphorothioate
  modified_base 2: mod_base = OTHER; note = 2'-deoxy-2'-fluorouridine-3'-phosphorothioate
  modified_base 3: mod_base = OTHER; note = 2'-O-methyladenosine-3'-phosphate
  modified_base 4: mod_base = OTHER; note = 2'-deoxy-2'-fluorouridine-3'-phosphate
  modified_base 5: mod_base = OTHER; note = 2'-O-methyladenosine-3'-phosphate
  modified_base 6: mod_base = OTHER; note = 2'-deoxy-2'-fluoroguanosine-3'-phosphate
  modified_base 7: mod_base = OTHER; note = 2'-O-methyladenosine-3'-phosphate
  modified_base 8: mod_base = OTHER; note = 2'-deoxy-2'-fluoroguanosine-3'-phosphate
  modified_base 9: mod_base = OTHER; note = 2'-O-methylcytidine-3'-phosphate
  modified_base 10: mod_base = OTHER; note = 2'-deoxy-2'-fluoroadenosine-3'-phosphate
  modified_base 11: mod_base = OTHER; note = 2'-O-methyladenosine-3'-phosphate
  modified_base 12: mod_base = OTHER; note = 2'-O-methylguanosine-3'-phosphate
  modified_base 13: mod_base = OTHER; note = 2'-O-methyladenosine-3'-phosphate
  modified_base 14: mod_base = OTHER; note = 2'-deoxy-2'-fluoroadenosine-3'-phosphate
  modified_base 15: mod_base = OTHER; note = 2'-O-methylcytidine-3'-phosphate
  modified_base 16: mod_base = OTHER; note = Adenosine-glycol nucleic acid (GNA), S-isomer
  modified_base 17: mod_base = OTHER; note = 2'-O-methylcytidine-3'-phosphate
  modified_base 18: mod_base = OTHER; note = 2'-deoxy-2'-fluorouridine-3'-phosphate
  modified_base 19: mod_base = OTHER; note = 2'-O-methylguanosine-3'-phosphate
  modified_base 20: mod_base = OTHER; note = 2'-deoxy-2'-fluorouridine-3'-phosphate
  modified_base 21: mod_base = OTHER; note = 2'-O-methyluridine-3'-phosphorothioate
  modified_base 22: mod_base = OTHER; note = 2'-O-methyluridine-3'-phosphorothioate
  modified_base 23: mod_base = OTHER; note = 2'-O-methyluridine
ttatagagcaagaacactgtttt

SEQ ID NO: 339 - RNA, 23 nt, synthetic construct
  source 1..23: mol_type = other RNA
  modified_base 1: mod_base = OTHER; note = 2'-O-methyluridine-3'-phosphorothioate
  modified_base 2: mod_base = OTHER; note = 2'-deoxy-2'-fluorouridine-3'-phosphorothioate
  modified_base 3: mod_base = OTHER; note = 2'-O-methyladenosine-3'-phosphate
  modified_base 4: mod_base = OTHER; note = 2'-deoxy-2'-fluorouridine-3'-phosphate
  modified_base 5: mod_base = OTHER; note = 2'-O-methyladenosine-3'-phosphate
  modified_base 6: mod_base = OTHER; note = 2'-deoxy-2'-fluoroguanosine-3'-phosphate
  modified_base 7: mod_base = OTHER; note = 2'-O-methyladenosine-3'-phosphate
  modified_base 8: mod_base = OTHER; note = 2'-deoxy-2'-fluoroguanosine-3'-phosphate
  modified_base 9: mod_base = OTHER; note = 2'-O-methylcytidine-3'-phosphate
  modified_base 10: mod_base = OTHER; note = 2'-deoxy-2'-fluoroadenosine-3'-phosphate
  modified_base 11: mod_base = OTHER; note = 2'-O-methyladenosine-3'-phosphate
  modified_base 12: mod_base = OTHER; note = 2'-O-methylguanosine-3'-phosphate
  modified_base 13: mod_base = OTHER; note = 2'-O-methyladenosine-3'-phosphate
  modified_base 14: mod_base = OTHER; note = 2'-deoxy-2'-fluoroadenosine-3'-phosphate
  modified_base 15: mod_base = OTHER; note = 2'-O-methylcytidine-3'-phosphate
  modified_base 16: mod_base = OTHER; note = 2'-deoxy-2'-fluoroadenosine-3'-phosphate
  modified_base 17: mod_base = OTHER; note = Cytidine-glycol nucleic acid (GNA), S-isomer
  modified_base 18: mod_base = OTHER; note = 2'-deoxy-2'-fluorouridine-3'-phosphate
  modified_base 19: mod_base = OTHER; note = 2'-O-methylguanosine-3'-phosphate
  modified_base 20: mod_base = OTHER; note = 2'-deoxy-2'-fluorouridine-3'-phosphate
  modified_base 21: mod_base = OTHER; note = 2'-O-methyluridine-3'-phosphorothioate
  modified_base 22: mod_base = OTHER; note = 2'-O-methyluridine-3'-phosphorothioate
  modified_base 23: mod_base = OTHER; note = 2'-O-methyluridine
ttatagagcaagaacactgtttt

SEQ ID NO: 340 - RNA, 23 nt, synthetic construct
  source 1..23: mol_type = other RNA
  modified_base 1: mod_base = OTHER; note = 2'-O-methyluridine-3'-phosphorothioate
  modified_base 2: mod_base = OTHER; note = 2'-deoxy-2'-fluorouridine-3'-phosphorothioate
  modified_base 3: mod_base = OTHER; note = 2'-O-methyladenosine-3'-phosphate
  modified_base 4: mod_base = OTHER; note = 2'-deoxy-2'-fluorouridine-3'-phosphate
  modified_base 5: mod_base = OTHER; note = 2'-O-methyladenosine-3'-phosphate
  modified_base 6: mod_base = OTHER; note = 2'-deoxy-2'-fluoroguanosine-3'-phosphate
  modified_base 7: mod_base = OTHER; note = 2'-O-methyladenosine-3'-phosphate
  modified_base 8: mod_base = OTHER; note = 2'-deoxy-2'-fluoroguanosine-3'-phosphate
  modified_base 9: mod_base = OTHER; note = 2'-O-methylcytidine-3'-phosphate
  modified_base 10: mod_base = OTHER; note = 2'-deoxy-2'-fluoroadenosine-3'-phosphate
  modified_base 11: mod_base = OTHER; note = 2'-O-methyladenosine-3'-phosphate
  modified_base 12: mod_base = OTHER; note = 2'-O-methylguanosine-3'-phosphate
  modified_base 13: mod_base = OTHER; note = 2'-O-methyladenosine-3'-phosphate
  modified_base 14: mod_base = OTHER; note = 2'-deoxy-2'-fluoroadenosine-3'-phosphate
  modified_base 15: mod_base = OTHER; note = 2'-O-methylcytidine-3'-phosphate
  modified_base 16: mod_base = OTHER; note = 2'-deoxy-2'-fluoroadenosine-3'-phosphate
  modified_base 17: mod_base = OTHER; note = 2'-O-methylcytidine-3'-phosphate
  modified_base 18: mod_base = OTHER; note = Thymidine-glycol nucleic acid (GNA), S-Isomer
  modified_base 19: mod_base = OTHER; note = 2'-O-methylguanosine-3'-phosphate
  modified_base 20: mod_base = OTHER; note = 2'-deoxy-2'-fluorouridine-3'-phosphate
  modified_base 21: mod_base = OTHER; note = 2'-O-methyluridine-3'-phosphorothioate
  modified_base 22: mod_base = OTHER; note = 2'-O-methyluridine-3'-phosphorothioate
  modified_base 23: mod_base = OTHER; note = 2'-O-methyluridine
ttatagagcaagaacactgtttt

SEQ ID NO: 341 - RNA, 23 nt, synthetic construct
  source 1..23: mol_type = other RNA
  modified_base 1: mod_base = OTHER; note = 2'-O-methyluridine-3'-phosphorothioate
  modified_base 2: mod_base = OTHER; note = 2'-deoxy-2'-fluorouridine-3'-phosphorothioate
  modified_base 3: mod_base = OTHER; note = 2'-O-methyladenosine-3'-phosphate
  modified_base 4: mod_base = OTHER; note = 2'-deoxy-2'-fluorouridine-3'-phosphate
  modified_base 5: mod_base = OTHER; note = 2'-O-methyladenosine-3'-phosphate
  modified_base 6: mod_base = OTHER; note = 2'-deoxy-2'-fluoroguanosine-3'-phosphate
  modified_base 7: mod_base = OTHER; note = 2'-O-methyladenosine-3'-phosphate
  modified_base 8: mod_base = OTHER; note = 2'-deoxy-2'-fluoroguanosine-3'-phosphate
  modified_base 9: mod_base = OTHER; note = 2'-O-methylcytidine-3'-phosphate
  modified_base 10: mod_base = OTHER; note = 2'-deoxy-2'-fluoroadenosine-3'-phosphate
  modified_base 11: mod_base = OTHER; note = 2'-O-methyladenosine-3'-phosphate
  modified_base 12: mod_base = OTHER; note = 2'-O-methylguanosine-3'-phosphate
  modified_base 13: mod_base = OTHER; note = 2'-O-methyladenosine-3'-phosphate
  modified_base 14: mod_base = OTHER; note = 2'-deoxy-2'-fluoroadenosine-3'-phosphate
  modified_base 15: mod_base = OTHER; note = 2'-O-methylcytidine-3'-phosphate
  modified_base 16: mod_base = OTHER; note = 2'-deoxy-2'-fluoroadenosine-3'-phosphate
  modified_base 17: mod_base = OTHER; note = 2'-O-methylcytidine-3'-phosphate
  modified_base 18: mod_base = OTHER; note = 2'-deoxy-2'-fluorouridine-3'-phosphate
  modified_base 19: mod_base = OTHER; note = Guanosine-glycol nucleic acid (GNA), S-isomer
  modified_base 20: mod_base = OTHER; note = 2'-deoxy-2'-fluorouridine-3'-phosphate
  modified_base 21: mod_base = OTHER; note = 2'-O-methyluridine-3'-phosphorothioate
  modified_base 22: mod_base = OTHER; note = 2'-O-methyluridine-3'-phosphorothioate
  modified_base 23: mod_base = OTHER; note = 2'-O-methyluridine
ttatagagcaagaacactgtttt

SEQ ID NO: 342 - RNA, 23 nt, synthetic construct
  source 1..23: mol_type = other RNA
  modified_base 1: mod_base = OTHER; note = 2'-O-methyluridine-3'-phosphorothioate
  modified_base 2: mod_base = OTHER; note = 2'-deoxy-2'-fluorouridine-3'-phosphorothioate
  modified_base 3: mod_base = OTHER; note = 2'-O-methyladenosine-3'-phosphate
  modified_base 4: mod_base = OTHER; note = 2'-deoxy-2'-fluorouridine-3'-phosphate
  modified_base 5: mod_base = OTHER; note = 2'-O-methyladenosine-3'-phosphate
  modified_base 6: mod_base = OTHER; note = 2'-deoxy-2'-fluoroguanosine-3'-phosphate
  modified_base 7: mod_base = OTHER; note = 2'-O-methyladenosine-3'-phosphate
  modified_base 8: mod_base = OTHER; note = 2'-deoxy-2'-fluoroguanosine-3'-phosphate
  modified_base 9: mod_base = OTHER; note = 2'-O-methylcytidine-3'-phosphate
  modified_base 10: mod_base = OTHER; note = 2'-deoxy-2'-fluoroadenosine-3'-phosphate
  modified_base 11: mod_base = OTHER; note = 2'-O-methyladenosine-3'-phosphate
  modified_base 12: mod_base = OTHER; note = 2'-O-methylguanosine-3'-phosphate
  modified_base 13: mod_base = OTHER; note = 2'-O-methyladenosine-3'-phosphate
  modified_base 14: mod_base = OTHER; note = 2'-deoxy-2'-fluoroadenosine-3'-phosphate
  modified_base 15: mod_base = OTHER; note = 2'-O-methylcytidine-3'-phosphate
  modified_base 16: mod_base = OTHER; note = 2'-deoxy-2'-fluoroadenosine-3'-phosphate
  modified_base 17: mod_base = OTHER; note = 2'-O-methylcytidine-3'-phosphate
  modified_base 18: mod_base = OTHER; note = 2'-deoxy-2'-fluorouridine-3'-phosphate
  modified_base 19: mod_base = OTHER; note = 2'-O-methylguanosine-3'-phosphate
  modified_base 20: mod_base = OTHER; note = Thymidine-glycol nucleic acid (GNA), S-Isomer
  modified_base 21: mod_base = OTHER; note = 2'-O-methyluridine-3'-phosphorothioate
  modified_base 22: mod_base = OTHER; note = 2'-O-methyluridine-3'-phosphorothioate
  modified_base 23: mod_base = OTHER; note = 2'-O-methyluridine
ttatagagcaagaacactgtttt

SEQ ID NO: 343 - RNA, 23 nt, synthetic construct
  source 1..23: mol_type = other RNA
  modified_base 1: mod_base = OTHER; note = 2'-O-methyluridine-3'-phosphorothioate
  modified_base 2: mod_base = OTHER; note = 2'-deoxy-2'-fluorouridine-3'-phosphorothioate
  modified_base 3: mod_base = OTHER; note = 2'-O-methyladenosine-3'-phosphate
  modified_base 4: mod_base = OTHER; note = 2'-deoxy-2'-fluorouridine-3'-phosphate
  modified_base 5: mod_base = OTHER; note = 2'-O-methyladenosine-3'-phosphate
  modified_base 6: mod_base = OTHER; note = 2'-deoxy-2'-fluoroguanosine-3'-phosphate
  modified_base 7: mod_base = OTHER; note = 2'-O-methyladenosine-3'-phosphate
  modified_base 8: mod_base = OTHER; note = 2'-deoxy-2'-fluoroguanosine-3'-phosphate
  modified_base 9: mod_base = OTHER; note = 2'-O-methylcytidine-3'-phosphate
  modified_base 10: mod_base = OTHER; note = 2'-deoxy-2'-fluoroadenosine-3'-phosphate
  modified_base 11: mod_base = OTHER; note = 2'-O-methyladenosine-3'-phosphate
  modified_base 12: mod_base = OTHER; note = 2'-O-methylguanosine-3'-phosphate
  modified_base 13: mod_base = OTHER; note = 2'-O-methyladenosine-3'-phosphate
  modified_base 14: mod_base = OTHER; note = 2'-deoxy-2'-fluoroadenosine-3'-phosphate
  modified_base 15: mod_base = OTHER; note = 2'-O-methylcytidine-3'-phosphate
  modified_base 16: mod_base = OTHER; note = 2'-deoxy-2'-fluoroadenosine-3'-phosphate
  modified_base 17: mod_base = OTHER; note = 2'-O-methylcytidine-3'-phosphate
  modified_base 18: mod_base = OTHER; note = 2'-deoxy-2'-fluorouridine-3'-phosphate
  modified_base 19: mod_base = OTHER; note = 2'-O-methylguanosine-3'-phosphate
  modified_base 20: mod_base = OTHER; note = 2'-deoxy-2'-fluorouridine-3'-phosphate
  modified_base 21: mod_base = OTHER; note = Thymidine-glycol nucleic acid (GNA), S-Isomer phosphorothioate
  modified_base 22: mod_base = OTHER; note = 2'-O-methyluridine-3'-phosphorothioate
  modified_base 23: mod_base = OTHER; note = 2'-O-methyluridine
ttatagagcaagaacactgtttt

SEQ ID NO: 344 - RNA, 23 nt, synthetic construct
  source 1..23: mol_type = other RNA
  modified_base 1: mod_base = OTHER; note = 2'-O-methyluridine-3'-phosphorothioate
  modified_base 2: mod_base = OTHER; note = 2'-deoxy-2'-fluorouridine-3'-phosphorothioate
  modified_base 3: mod_base = OTHER; note = 2'-O-methyladenosine-3'-phosphate
  modified_base 4: mod_base = OTHER; note = 2'-deoxy-2'-fluorouridine-3'-phosphate
  modified_base 5: mod_base = OTHER; note = 2'-O-methyladenosine-3'-phosphate
  modified_base 6: mod_base = OTHER; note = 2'-deoxy-2'-fluoroguanosine-3'-phosphate
  modified_base 7: mod_base = OTHER; note = 2'-O-methyladenosine-3'-phosphate
  modified_base 8: mod_base = OTHER; note = 2'-deoxy-2'-fluoroguanosine-3'-phosphate
  modified_base 9: mod_base = OTHER; note = 2'-O-methylcytidine-3'-phosphate
  modified_base 10: mod_base = OTHER; note = 2'-deoxy-2'-fluoroadenosine-3'-phosphate
  modified_base 11: mod_base = OTHER; note = 2'-O-methyladenosine-3'-phosphate
  modified_base 12: mod_base = OTHER; note = 2'-O-methylguanosine-3'-phosphate
  modified_base 13: mod_base = OTHER; note = 2'-O-methyladenosine-3'-phosphate
  modified_base 14: mod_base = OTHER; note = 2'-deoxy-2'-fluoroadenosine-3'-phosphate
  modified_base 15: mod_base = OTHER; note = 2'-O-methylcytidine-3'-phosphate
  modified_base 16: mod_base = OTHER; note = 2'-deoxy-2'-fluoroadenosine-3'-phosphate
  modified_base 17: mod_base = OTHER; note = 2'-O-methylcytidine-3'-phosphate
  modified_base 18: mod_base = OTHER; note = 2'-deoxy-2'-fluorouridine-3'-phosphate
  modified_base 19: mod_base = OTHER; note = 2'-O-methylguanosine-3'-phosphate
  modified_base 20: mod_base = OTHER; note = 2'-deoxy-2'-fluorouridine-3'-phosphate
  modified_base 21: mod_base = OTHER; note = 2'-O-methyluridine-3'-phosphorothioate
  modified_base 22: mod_base = OTHER; note = Thymidine-glycol nucleic acid (GNA), S-Isomer phosphorothioate
  modified_base 23: mod_base = OTHER; note = 2'-O-methyluridine
ttatagagcaagaacactgtttt

SEQ ID NO: 345 - RNA, 23 nt, synthetic construct
  source 1..23: mol_type = other RNA
  modified_base 1: mod_base = OTHER; note = 2'-O-methyluridine-3'-phosphorothioate
  modified_base 2: mod_base = OTHER; note = 2'-deoxy-2'-fluorouridine-3'-phosphorothioate
  modified_base 3: mod_base = OTHER; note = 2'-O-methyladenosine-3'-phosphate
  modified_base 4: mod_base = OTHER; note = 2'-deoxy-2'-fluorouridine-3'-phosphate
  modified_base 5: mod_base = OTHER; note = 2'-O-methyladenosine-3'-phosphate
  modified_base 6: mod_base = OTHER; note = 2'-deoxy-2'-fluoroguanosine-3'-phosphate
  modified_base 7: mod_base = OTHER; note = 2'-O-methyladenosine-3'-phosphate
  modified_base 8: mod_base = OTHER; note = 2'-deoxy-2'-fluoroguanosine-3'-phosphate
  modified_base 9: mod_base = OTHER; note = 2'-O-methylcytidine-3'-phosphate
  modified_base 10: mod_base = OTHER; note = 2'-deoxy-2'-fluoroadenosine-3'-phosphate
  modified_base 11: mod_base = OTHER; note = 2'-O-methyladenosine-3'-phosphate
  modified_base 12: mod_base = OTHER; note = 2'-O-methylguanosine-3'-phosphate
  modified_base 13: mod_base = OTHER; note = 2'-O-methyladenosine-3'-phosphate
  modified_base 14: mod_base = OTHER; note = 2'-deoxy-2'-fluoroadenosine-3'-phosphate
  modified_base 15: mod_base = OTHER; note = 2'-O-methylcytidine-3'-phosphate
  modified_base 16: mod_base = OTHER; note = 2'-deoxy-2'-fluoroadenosine-3'-phosphate
  modified_base 17: mod_base = OTHER; note = 2'-O-methylcytidine-3'-phosphate
  modified_base 18: mod_base = OTHER; note = 2'-deoxy-2'-fluorouridine-3'-phosphate
  modified_base 19: mod_base = OTHER; note = 2'-O-methylguanosine-3'-phosphate
  modified_base 20: mod_base = OTHER; note = 2'-deoxy-2'-fluorouridine-3'-phosphate
  modified_base 21: mod_base = OTHER; note = 2'-O-methyluridine-3'-phosphorothioate
  modified_base 22: mod_base = OTHER; note = 2'-O-methyluridine-3'-phosphorothioate
  modified_base 23: mod_base = OTHER; note = Thymidine-glycol nucleic acid (GNA) S-Isomer
ttatagagcaagaacactgtttt

SEQ ID NO: 346 - RNA, 23 nt, synthetic construct
  source 1..23: mol_type = other RNA
  modified_base 1: mod_base = OTHER; note = 2'-O-methyluridine-3'-phosphorothioate
  modified_base 2: mod_base = OTHER; note = 2'-deoxy-2'-fluorouridine-3'-phosphorothioate
  modified_base 3: mod_base = OTHER; note = 2'-O-methyladenosine-3'-phosphate
  modified_base 4: mod_base = OTHER; note = 2'-deoxy-2'-fluorouridine-3'-phosphate
  modified_base 5: mod_base = OTHER; note = 2'-O-methyladenosine-3'-phosphate
  modified_base 6: mod_base = OTHER; note = 2'-deoxy-2'-fluoroguanosine-3'-phosphate
  modified_base 7: mod_base = OTHER; note = 2'-O-methyladenosine-3'-phosphate
  modified_base 8: mod_base = OTHER; note = 2'-deoxy-2'-fluoroguanosine-3'-phosphate
  modified_base 9: mod_base = OTHER; note = 2'-O-methylcytidine-3'-phosphate
  modified_base 10: mod_base = OTHER; note = 2'-deoxy-2'-fluoroadenosine-3'-phosphate
  modified_base 11: mod_base = OTHER; note = 2'-O-methyladenosine-3'-phosphate
  modified_base 12: mod_base = OTHER; note = 2'-O-methylguanosine-3'-phosphate
  modified_base 13: mod_base = OTHER; note = 2'-O-methyladenosine-3'-phosphate
  modified_base 14: mod_base = OTHER; note = 2'-deoxy-2'-fluoroadenosine-3'-phosphate
  modified_base 15: mod_base = OTHER; note = 2'-O-methylcytidine-3'-phosphate
  modified_base 16: mod_base = OTHER; note = 2'-deoxy-2'-fluoroadenosine-3'-phosphate
  modified_base 17: mod_base = OTHER; note = 2'-O-methylcytidine-3'-phosphate
  modified_base 18: mod_base = OTHER; note = 2'-deoxy-2'-fluorouridine-3'-phosphate
  modified_base 19: mod_base = OTHER; note = 2'-O-methylguanosine-3'-phosphate
  modified_base 20: mod_base = OTHER; note = 2'-deoxy-2'-fluorouridine-3'-phosphate
  modified_base 21: mod_base = OTHER; note = 2'-O-methyluridine-3'-phosphorothioate
  modified_base 22: mod_base = OTHER; note = 2'-O-methyluridine-3'-phosphorothioate
  modified_base 23: mod_base = OTHER; note = 2'-O-methyluridine
ttatagagcaagaacactgtttt

SEQ ID NO: 347 - RNA, 23 nt, synthetic construct
  source 1..23: mol_type = other RNA
  modified_base 1: mod_base = OTHER; note = 2'-O-methyluridine-3'-phosphorothioate
  modified_base 2: mod_base = OTHER; note = 2'-deoxy-2'-fluorouridine-3'-phosphorothioate
  modified_base 3: mod_base = OTHER; note = 2'-O-methyladenosine-3'-phosphate
  modified_base 4: mod_base = OTHER; note = 2'-deoxy-2'-fluorouridine-3'-phosphate
  modified_base 5: mod_base = OTHER; note = 2'-O-methyladenosine-3'-phosphate
  modified_base 6: mod_base = OTHER; note = 2'-deoxy-2'-fluoroguanosine-3'-phosphate
  modified_base 7: mod_base = OTHER; note = 2'-O-methyladenosine-3'-phosphate
  modified_base 8: mod_base = OTHER; note = 2'-deoxy-2'-fluoroguanosine-3'-phosphate
  modified_base 9: mod_base = OTHER; note = 2'-O-methylcytidine-3'-phosphate
  modified_base 10: mod_base = OTHER; note = 2'-deoxy-2'-fluoroadenosine-3'-phosphate
  modified_base 11: mod_base = OTHER; note = 2'-O-methyladenosine-3'-phosphate
  modified_base 12: mod_base = OTHER; note = 2'-O-methylguanosine-3'-phosphate
  modified_base 13: mod_base = OTHER; note = 2'-O-methyladenosine-3'-phosphate
  modified_base 14: mod_base = OTHER; note = 2'-deoxy-2'-fluoroadenosine-3'-phosphate
  modified_base 15: mod_base = OTHER; note = 2'-O-methylcytidine-3'-phosphate
  modified_base 16: mod_base = OTHER; note = 2'-deoxy-2'-fluoroadenosine-3'-phosphate
  modified_base 17: mod_base = OTHER; note = 2'-O-methylcytidine-3'-phosphate
  modified_base 18: mod_base = OTHER; note = 2'-deoxy-2'-fluorouridine-3'-phosphate
  modified_base 19: mod_base = OTHER; note = 2'-O-methylguanosine-3'-phosphate
  modified_base 20: mod_base = OTHER; note = 2'-deoxy-2'-fluorouridine-3'-phosphate
  modified_base 21: mod_base = OTHER; note = 2'-O-methyluridine-3'-phosphorothioate
  modified_base 22: mod_base = OTHER; note = 2'-O-methyluridine-3'-phosphorothioate
  modified_base 23: mod_base = OTHER; note = 2'-O-methyluridine
ttatagagcaagaacactgtttt

SEQ ID NO: 348 - RNA, 23 nt, synthetic construct
  source 1..23: mol_type = other RNA
  modified_base 1: mod_base = OTHER; note = 2'-O-methyluridine-3'-phosphorothioate
  modified_base 2: mod_base = OTHER; note = 2'-deoxy-2'-fluorouridine-3'-phosphorothioate
  modified_base 3: mod_base = OTHER; note = 2'-O-methyladenosine-3'-phosphate
  modified_base 4: mod_base = OTHER; note = 2'-deoxy-2'-fluorouridine-3'-phosphate
  modified_base 5: mod_base = OTHER; note = 2'-O-methyladenosine-3'-phosphate
  modified_base 6: mod_base = OTHER; note = 2'-deoxy-2'-fluoroguanosine-3'-phosphate
  modified_base 7: mod_base = OTHER; note = 2'-O-methyladenosine-3'-phosphate
  modified_base 8: mod_base = OTHER; note = 2'-deoxy-2'-fluoroguanosine-3'-phosphate
  modified_base 9: mod_base = OTHER; note = 2'-O-methylcytidine-3'-phosphate
  modified_base 10: mod_base = OTHER; note = 2'-deoxy-2'-fluoroadenosine-3'-phosphate
  modified_base 11: mod_base = OTHER; note = 2'-O-methyladenosine-3'-phosphate
  modified_base 12: mod_base = OTHER; note = 2'-O-methylguanosine-3'-phosphate
  modified_base 13: mod_base = OTHER; note = 2'-O-methyladenosine-3'-phosphate
  modified_base 14: mod_base = OTHER; note = 2'-deoxy-2'-fluoroadenosine-3'-phosphate
  modified_base 15: mod_base = OTHER; note = 2'-O-methylcytidine-3'-phosphate
  modified_base 16: mod_base = OTHER; note = 2'-deoxy-2'-fluoroadenosine-3'-phosphate
  modified_base 17: mod_base = OTHER; note = 2'-O-methylcytidine-3'-phosphate
  modified_base 18: mod_base = OTHER; note = 2'-deoxy-2'-fluorouridine-3'-phosphate
  modified_base 19: mod_base = OTHER; note = 2'-O-methylguanosine-3'-phosphate
  modified_base 20: mod_base = OTHER; note = 2'-deoxy-2'-fluorouridine-3'-phosphate
  modified_base 21: mod_base = OTHER; note = 2'-O-methyluridine-3'-phosphorothioate
  modified_base 22: mod_base = OTHER; note = 2'-O-methyluridine-3'-phosphorothioate
  modified_base 23: mod_base = OTHER; note = 2'-O-methyluridine
ttatagagcaagaacactgtttt

SEQ ID NO: 349 - RNA, 23 nt, synthetic construct
  source 1..23: mol_type = other RNA
  modified_base 1: mod_base = OTHER; note = 2'-O-methyluridine-3'-phosphorothioate
  modified_base 2: mod_base = OTHER; note = 2'-deoxy-2'-fluorouridine-3'-phosphorothioate
  modified_base 3: mod_base = OTHER; note = 2'-O-methyladenosine-3'-phosphate
  modified_base 4: mod_base = OTHER; note = 2'-deoxy-2'-fluorouridine-3'-phosphate
  modified_base 5: mod_base = OTHER; note = 2'-O-methyladenosine-3'-phosphate
  modified_base 6: mod_base = OTHER; note = 2'-deoxy-2'-fluoroguanosine-3'-phosphate
  modified_base 7: mod_base = OTHER; note = 2'-O-methyladenosine-3'-phosphate
  modified_base 8: mod_base = OTHER; note = 2'-deoxy-2'-fluoroguanosine-3'-phosphate
  modified_base 9: mod_base = OTHER; note = 2'-O-methylcytidine-3'-phosphate
  modified_base 10: mod_base = OTHER; note = 2'-deoxy-2'-fluoroadenosine-3'-phosphate
  modified_base 11: mod_base = OTHER; note = 2'-O-methyladenosine-3'-phosphate
  modified_base 12: mod_base = OTHER; note = 2'-O-methylguanosine-3'-phosphate
  modified_base 13: mod_base = OTHER; note = 2'-O-methyladenosine-3'-phosphate
  modified_base 14: mod_base = OTHER; note = 2'-deoxy-2'-fluoroadenosine-3'-phosphate
  modified_base 15: mod_base = OTHER; note = 2'-O-methylcytidine-3'-phosphate
  modified_base 16: mod_base = OTHER; note = 2'-deoxy-2'-fluoroadenosine-3'-phosphate
  modified_base 17: mod_base = OTHER; note = 2'-O-methylcytidine-3'-phosphate
  modified_base 18: mod_base = OTHER; note = 2'-deoxy-2'-fluorouridine-3'-phosphate
  modified_base 19: mod_base = OTHER; note = 2'-O-methylguanosine-3'-phosphate
  modified_base 20: mod_base = OTHER; note = 2'-deoxy-2'-fluorouridine-3'-phosphate
  modified_base 21: mod_base = OTHER; note = 2'-O-methyluridine-3'-phosphorothioate
  modified_base 22: mod_base = OTHER; note = 2'-O-methyluridine-3'-phosphorothioate
  modified_base 23: mod_base = OTHER; note = 2'-O-methyluridine
ttatagagcaagaacactgtttt

SEQ ID NO: 350 - RNA, 23 nt, synthetic construct
  source 1..23: mol_type = other RNA
  modified_base 1: mod_base = OTHER; note = 2'-O-methyluridine-3'-phosphorothioate
  modified_base 2: mod_base = OTHER; note = 2'-deoxy-2'-fluorouridine-3'-phosphorothioate
  modified_base 3: mod_base = OTHER; note = 2'-O-methyladenosine-3'-phosphate
  modified_base 4: mod_base = OTHER; note = 2'-deoxy-2'-fluorouridine-3'-phosphate
  modified_base 5: mod_base = OTHER; note = 2'-O-methyladenosine-3'-phosphate
  modified_base 6: mod_base = OTHER; note = 2'-deoxy-2'-fluoroguanosine-3'-phosphate
  modified_base 7: mod_base = OTHER; note = 2'-O-methyladenosine-3'-phosphate
  modified_base 8: mod_base = OTHER; note = 2'-deoxy-2'-fluoroguanosine-3'-phosphate
  modified_base 9: mod_base = OTHER; note = 2'-O-methylcytidine-3'-phosphate
  modified_base 10: mod_base = OTHER; note = 2'-deoxy-2'-fluoroadenosine-3'-phosphate
  modified_base 11: mod_base = OTHER; note = 2'-O-methyladenosine-3'-phosphate
  modified_base 12: mod_base = OTHER; note = 2'-O-methylguanosine-3'-phosphate
  modified_base 13: mod_base = OTHER; note = 2'-O-methyladenosine-3'-phosphate
  modified_base 14: mod_base = OTHER; note = 2'-deoxy-2'-fluoroadenosine-3'-phosphate
  modified_base 15: mod_base = OTHER; note = 2'-O-methylcytidine-3'-phosphate
  modified_base 16: mod_base = OTHER; note = 2'-deoxy-2'-fluoroadenosine-3'-phosphate
  modified_base 17: mod_base = OTHER; note = 2'-O-methylcytidine-3'-phosphate
  modified_base 18: mod_base = OTHER; note = 2'-deoxy-2'-fluorouridine-3'-phosphate
  modified_base 19: mod_base = OTHER; note = 2'-O-methylguanosine-3'-phosphate
  modified_base 20: mod_base = OTHER; note = 2'-deoxy-2'-fluorouridine-3'-phosphate
  modified_base 21: mod_base = OTHER; note = 2'-O-methyluridine-3'-phosphorothioate
  modified_base 22: mod_base = OTHER; note = 2'-O-methyluridine-3'-phosphorothioate
  modified_base 23: mod_base = OTHER; note = 2'-O-methyluridine
ttatagagcaagaacactgtttt

SEQ ID NO: 351 - RNA, 23 nt, synthetic construct
  source 1..23: mol_type = other RNA
  modified_base 1: mod_base = OTHER; note = 2'-O-methyluridine-3'-phosphorothioate
  modified_base 2: mod_base = OTHER; note = 2'-deoxy-2'-fluorouridine-3'-phosphorothioate
  modified_base 3: mod_base = OTHER; note = 2'-O-methyladenosine-3'-phosphate
  modified_base 4: mod_base = OTHER; note = 2'-deoxy-2'-fluorouridine-3'-phosphate
  modified_base 5: mod_base = OTHER; note = 2'-O-methyladenosine-3'-phosphate
  modified_base 6: mod_base = OTHER; note = 2'-deoxy-2'-fluoroguanosine-3'-phosphate
  modified_base 7: mod_base = OTHER; note = 2'-O-methyladenosine-3'-phosphate
  modified_base 8: mod_base = OTHER; note = 2'-deoxy-2'-fluoroguanosine-3'-phosphate
  modified_base 9: mod_base = OTHER; note = 2'-O-methylcytidine-3'-phosphate
  modified_base 10: mod_base = OTHER; note = 2'-deoxy-2'-fluoroadenosine-3'-phosphate
  modified_base 11: mod_base = OTHER; note = 2'-O-methyladenosine-3'-phosphate
  modified_base 12: mod_base = OTHER; note = 2'-O-methylguanosine-3'-phosphate
  modified_base 13: mod_base = OTHER; note = 2'-O-methyladenosine-3'-phosphate
  modified_base 14: mod_base = OTHER; note = 2'-deoxy-2'-fluoroadenosine-3'-phosphate
  modified_base 15: mod_base = OTHER; note = 2'-O-methylcytidine-3'-phosphate
  modified_base 16: mod_base = OTHER; note = 2'-deoxy-2'-fluoroadenosine-3'-phosphate
  modified_base 17: mod_base = OTHER; note = 2'-O-methylcytidine-3'-phosphate
  modified_base 18: mod_base = OTHER; note = 2'-deoxy-2'-fluorouridine-3'-phosphate
  modified_base 19: mod_base = OTHER; note = 2'-O-methylguanosine-3'-phosphate
  modified_base 20: mod_base = OTHER; note = 2'-deoxy-2'-fluorouridine-3'-phosphate
  modified_base 21: mod_base = OTHER; note = 2'-O-methyluridine-3'-phosphorothioate
  modified_base 22: mod_base = OTHER; note = 2'-O-methyluridine-3'-phosphorothioate
  modified_base 23: mod_base = OTHER; note = 2'-O-methyluridine
ttatagagcaagaacactgtttt

SEQ ID NO: 352 - RNA, 23 nt, synthetic construct
  source 1..23: mol_type = other RNA
  modified_base 1: mod_base = OTHER; note = 2'-O-methyluridine-3'-phosphorothioate
  modified_base 2: mod_base = OTHER; note = 2'-deoxy-2'-fluorouridine-3'-phosphorothioate
  modified_base 3: mod_base = OTHER; note = 2'-O-methyladenosine-3'-phosphate
  modified_base 4: mod_base = OTHER; note = 2'-deoxy-2'-fluorouridine-3'-phosphate
  modified_base 5: mod_base = OTHER; note = 2'-O-methyladenosine-3'-phosphate
  modified_base 6: mod_base = OTHER; note = 2'-deoxy-2'-fluoroguanosine-3'-phosphate
  modified_base 7: mod_base = OTHER; note = 2'-O-methyladenosine-3'-phosphate
  modified_base 8: mod_base = OTHER; note = 2'-deoxy-2'-fluoroguanosine-3'-phosphate
  modified_base 9: mod_base = OTHER; note = 2'-O-methylcytidine-3'-phosphate
  modified_base 10: mod_base = OTHER; note = 2'-deoxy-2'-fluoroadenosine-3'-phosphate
  modified_base 11: mod_base = OTHER; note = 2'-O-methyladenosine-3'-phosphate
  modified_base 12: mod_base = OTHER; note = 2'-O-methylguanosine-3'-phosphate
  modified_base 13: mod_base = OTHER; note = 2'-O-methyladenosine-3'-phosphate
  modified_base 14: mod_base = OTHER; note = 2'-deoxy-2'-fluoroadenosine-3'-phosphate
  modified_base 15: mod_base = OTHER; note = 2'-O-methylcytidine-3'-phosphate
  modified_base 16: mod_base = OTHER; note = 2'-deoxy-2'-fluoroadenosine-3'-phosphate
  modified_base 17: mod_base = OTHER; note = 2'-O-methylcytidine-3'-phosphate
  modified_base 18: mod_base = OTHER; note = 2'-deoxy-2'-fluorouridine-3'-phosphate
  modified_base 19: mod_base = OTHER; note = 2'-O-methylguanosine-3'-phosphate
  modified_base 20: mod_base = OTHER; note = 2'-deoxy-2'-fluorouridine-3'-phosphate
  modified_base 21: mod_base = OTHER; note = 2'-O-methyluridine-3'-phosphorothioate
  modified_base 22: mod_base = OTHER; note = 2'-O-methyluridine-3'-phosphorothioate
  modified_base 23: mod_base = OTHER; note = 2'-O-methyluridine
ttatagagcaagaacactgtttt

SEQ ID NO: 353 - RNA, 23 nt, synthetic construct
  source 1..23: mol_type = other RNA
  modified_base 1: mod_base = OTHER; note = 2'-O-methyluridine-3'-phosphorothioate
  modified_base 2: mod_base = OTHER; note = 2'-deoxy-2'-fluorouridine-3'-phosphorothioate
  modified_base 3: mod_base = OTHER; note = 2'-O-methyladenosine-3'-phosphate
  modified_base 4: mod_base = OTHER; note = 2'-deoxy-2'-fluorouridine-3'-phosphate
  modified_base 5: mod_base = OTHER; note = 2'-O-methyladenosine-3'-phosphate
  modified_base 6: mod_base = OTHER; note = 2'-deoxy-2'-fluoroguanosine-3'-phosphate
  modified_base 7: mod_base = OTHER; note = 2'-O-methyladenosine-3'-phosphate
  modified_base 8: mod_base = OTHER; note = 2'-deoxy-2'-fluoroguanosine-3'-phosphate
  modified_base 9: mod_base = OTHER; note = 2'-O-methylcytidine-3'-phosphate
  modified_base 10: mod_base = OTHER; note = 2'-deoxy-2'-fluoroadenosine-3'-phosphate
  modified_base 11: mod_base = OTHER; note = 2'-O-methyladenosine-3'-phosphate
  modified_base 12: mod_base = OTHER; note = 2'-O-methylguanosine-3'-phosphate
  modified_base 13: mod_base = OTHER; note = 2'-O-methyladenosine-3'-phosphate
  modified_base 14: mod_base = OTHER; note = 2'-deoxy-2'-fluoroadenosine-3'-phosphate
  modified_base 15: mod_base = OTHER; note = 2'-O-methylcytidine-3'-phosphate
  modified_base 16: mod_base = OTHER; note = 2'-deoxy-2'-fluoroadenosine-3'-phosphate
  modified_base 17: mod_base = OTHER; note = 2'-O-methylcytidine-3'-phosphate
  modified_base 18: mod_base = OTHER; note = 2'-deoxy-2'-fluorouridine-3'-phosphate
  modified_base 19: mod_base = OTHER; note = 2'-O-methylguanosine-3'-phosphate
  modified_base 20: mod_base = OTHER; note = 2'-deoxy-2'-fluorouridine-3'-phosphate
  modified_base 21: mod_base = OTHER; note = 2'-O-methyluridine-3'-phosphorothioate
  modified_base 22: mod_base = OTHER; note = 2'-O-methyluridine-3'-phosphorothioate
  modified_base 23: mod_base = OTHER; note = 2'-O-methyluridine
ttatagagcaagaacactgtttt

SEQ ID NO: 354 - RNA, 23 nt, synthetic construct
  source 1..23: mol_type = other RNA
  modified_base 1: mod_base = OTHER; note = 2'-O-methyluridine-3'-phosphorothioate
  modified_base 2: mod_base = OTHER; note = 2'-deoxy-2'-fluorouridine-3'-phosphorothioate
  modified_base 3: mod_base = OTHER; note = 2'-O-methyladenosine-3'-phosphate
  modified_base 4: mod_base = OTHER; note = 2'-deoxy-2'-fluorouridine-3'-phosphate
  modified_base 5: mod_base = OTHER; note = 2'-O-methyladenosine-3'-phosphate
  modified_base 6: mod_base = OTHER; note = 2'-deoxy-2'-fluoroguanosine-3'-phosphate
  modified_base 7: mod_base = OTHER; note = 2'-O-methyladenosine-3'-phosphate
  modified_base 8: mod_base = OTHER; note = 2'-deoxy-2'-fluoroguanosine-3'-phosphate
  modified_base 9: mod_base = OTHER; note = 2'-O-methylcytidine-3'-phosphate
  modified_base 10: mod_base = OTHER; note = 2'-deoxy-2'-fluoroadenosine-3'-phosphate
  modified_base 11: mod_base = OTHER; note = 2'-O-methyladenosine-3'-phosphate
  modified_base 12: mod_base = OTHER; note = 2'-O-methylguanosine-3'-phosphate
  modified_base 13: mod_base = OTHER; note = 2'-O-methyladenosine-3'-phosphate
  modified_base 14: mod_base = OTHER; note = 2'-deoxy-2'-fluoroadenosine-3'-phosphate
  modified_base 15: mod_base = OTHER; note = 2'-O-methylcytidine-3'-phosphate
  modified_base 16: mod_base = OTHER; note = 2'-deoxy-2'-fluoroadenosine-3'-phosphate
  modified_base 17: mod_base = OTHER; note = 2'-O-methylcytidine-3'-phosphate
  modified_base 18: mod_base = OTHER; note = 2'-deoxy-2'-fluorouridine-3'-phosphate
  modified_base 19: mod_base = OTHER; note = 2'-O-methylguanosine-3'-phosphate
  modified_base 20: mod_base = OTHER; note = 2'-deoxy-2'-fluorouridine-3'-phosphate
  modified_base 21: mod_base = OTHER; note = 2'-O-methyluridine-3'-phosphorothioate
  modified_base 22: mod_base = OTHER; note = 2'-O-methyluridine-3'-phosphorothioate
  modified_base 23: mod_base = OTHER; note = 2'-O-methyluridine
ttatagagcaagaacactgtttt

SEQ ID NO: 355 - RNA, 23 nt, synthetic construct
  source 1..23: mol_type = other RNA
  modified_base 1: mod_base = OTHER; note = 2'-O-methyluridine-3'-phosphorothioate
  modified_base 2: mod_base = OTHER; note = 2'-deoxy-2'-fluorouridine-3'-phosphorothioate
  modified_base 3: mod_base = OTHER; note = 2'-O-methyladenosine-3'-phosphate
  modified_base 4: mod_base = OTHER; note = 2'-deoxy-2'-fluorouridine-3'-phosphate
  modified_base 5: mod_base = OTHER; note = 2'-O-methyladenosine-3'-phosphate
  modified_base 6: mod_base = OTHER; note = 2'-deoxy-2'-fluoroguanosine-3'-phosphate
  modified_base 7: mod_base = OTHER; note = 2'-O-methyladenosine-3'-phosphate
  modified_base 8: mod_base = OTHER; note = 2'-deoxy-2'-fluoroguanosine-3'-phosphate
  modified_base 9: mod_base = OTHER; note = 2'-O-methylcytidine-3'-phosphate
  modified_base 10: mod_base = OTHER; note = 2'-deoxy-2'-fluoroadenosine-3'-phosphate
  modified_base 11: mod_base = OTHER; note = 2'-O-methyladenosine-3'-phosphate
  modified_base 12: mod_base = OTHER; note = 2'-O-methylguanosine-3'-phosphate
  modified_base 13: mod_base = OTHER; note = 2'-O-methyladenosine-3'-phosphate
  modified_base 14: mod_base = OTHER; note = 2'-deoxy-2'-fluoroadenosine-3'-phosphate
  modified_base 15: mod_base = OTHER; note = 2'-O-methylcytidine-3'-phosphate
  modified_base 16: mod_base = OTHER; note = 2'-deoxy-2'-fluoroadenosine-3'-phosphate
  modified_base 17: mod_base = OTHER; note = 2'-O-methylcytidine-3'-phosphate
  modified_base 18: mod_base = OTHER; note = 2'-deoxy-2'-fluorouridine-3'-phosphate
  modified_base 19: mod_base = OTHER; note = 2'-O-methylguanosine-3'-phosphate
  modified_base 20: mod_base = OTHER; note = 2'-deoxy-2'-fluorouridine-3'-phosphate
  modified_base 21: mod_base = OTHER; note = 2'-O-methyluridine-3'-phosphorothioate
  modified_base 22: mod_base = OTHER; note = 2'-O-methyluridine-3'-phosphorothioate
  modified_base 23: mod_base = OTHER; note = 2'-O-methyluridine
ttatagagcaagaacactgtttt

SEQ ID NO: 356 - RNA, 23 nt, synthetic construct
  source 1..23: mol_type = other RNA
  modified_base 1: mod_base = OTHER; note = 2'-O-methyluridine-3'-phosphorothioate
  modified_base 2: mod_base = OTHER; note = 2'-deoxy-2'-fluorouridine-3'-phosphorothioate
  modified_base 3: mod_base = OTHER; note = 2'-O-methyladenosine-3'-phosphate
  modified_base 4: mod_base = OTHER; note = 2'-deoxy-2'-fluorouridine-3'-phosphate
  modified_base 5: mod_base = OTHER; note = 2'-O-methyladenosine-3'-phosphate
  modified_base 6: mod_base = OTHER; note = 2'-deoxy-2'-fluoroguanosine-3'-phosphate
  modified_base 7: mod_base = OTHER; note = 2'-O-methyladenosine-3'-phosphate
  modified_base 8: mod_base = OTHER; note = 2'-deoxy-2'-fluoroguanosine-3'-phosphate
  modified_base 9: mod_base = OTHER; note = 2'-O-methylcytidine-3'-phosphate
  modified_base 10: mod_base = OTHER; note = 2'-deoxy-2'-fluoroadenosine-3'-phosphate
  modified_base 11: mod_base = OTHER; note = 2'-O-methyladenosine-3'-phosphate
  modified_base 12: mod_base = OTHER; note = 2'-O-methylguanosine-3'-phosphate
  modified_base 13: mod_base = OTHER; note = 2'-O-methyladenosine-3'-phosphate
  modified_base 14: mod_base = OTHER; note = 2'-deoxy-2'-fluoroadenosine-3'-phosphate
  modified_base 15: mod_base = OTHER; note = 2'-O-methylcytidine-3'-phosphate
  modified_base 16: mod_base = OTHER; note = 2'-deoxy-2'-fluoroadenosine-3'-phosphate
  modified_base 17: mod_base = OTHER; note = 2'-O-methylcytidine-3'-phosphate
  modified_base 18: mod_base = OTHER; note = 2'-deoxy-2'-fluorouridine-3'-phosphate
  modified_base 19: mod_base = OTHER; note = 2'-O-methylguanosine-3'-phosphate
  modified_base 20: mod_base = OTHER; note = 2'-deoxy-2'-fluorouridine-3'-phosphate
  modified_base 21: mod_base = OTHER; note = 2'-O-methyluridine-3'-phosphorothioate
  modified_base 22: mod_base = OTHER; note = 2'-O-methyluridine-3'-phosphorothioate
  modified_base 23: mod_base = OTHER; note = 2'-O-methyluridine
ttatagagcaagaacactgtttt

SEQ ID NO: 357 - RNA, 23 nt, synthetic construct
  source 1..23: mol_type = other RNA
  modified_base 1: mod_base = OTHER; note = 2'-O-methyluridine-3'-phosphorothioate
  modified_base 2: mod_base = OTHER; note = 2'-deoxy-2'-fluorouridine-3'-phosphorothioate
  modified_base 3: mod_base = OTHER; note = 2'-O-methyladenosine-3'-phosphate
  modified_base 4: mod_base = OTHER; note = 2'-deoxy-2'-fluorouridine-3'-phosphate
  modified_base 5: mod_base = OTHER; note = 2'-O-methyladenosine-3'-phosphate
  modified_base 6: mod_base = OTHER; note = 2'-deoxy-2'-fluoroguanosine-3'-phosphate
  modified_base 7: mod_base = OTHER; note = 2'-O-methyladenosine-3'-phosphate
  modified_base 8: mod_base = OTHER; note = 2'-deoxy-2'-fluoroguanosine-3'-phosphate
  modified_base 9: mod_base = OTHER; note = 2'-O-methylcytidine-3'-phosphate
  modified_base 10: mod_base = OTHER; note = 2'-deoxy-2'-fluoroadenosine-3'-phosphate
  modified_base 11: mod_base = OTHER; note = 2'-O-methyladenosine-3'-phosphate
  modified_base 12: mod_base = OTHER; note = 2'-O-methylguanosine-3'-phosphate
  modified_base 13: mod_base = OTHER; note = 2'-O-methyladenosine-3'-phosphate
  modified_base 14: mod_base = OTHER; note = 2'-deoxy-2'-fluoroadenosine-3'-phosphate
  modified_base 15: mod_base = OTHER; note = 2'-O-methylcytidine-3'-phosphate
  modified_base 16: mod_base = OTHER; note = 2'-deoxy-2'-fluoroadenosine-3'-phosphate
  modified_base 17: mod_base = OTHER; note = 2'-O-methylcytidine-3'-phosphate
  modified_base 18: mod_base = OTHER; note = 2'-deoxy-2'-fluorouridine-3'-phosphate
  modified_base 19: mod_base = OTHER; note = 2'-O-methylguanosine-3'-phosphate
  modified_base 20: mod_base = OTHER; note = 2'-deoxy-2'-fluorouridine-3'-phosphate
  modified_base 21: mod_base = OTHER; note = 2'-O-methyluridine-3'-phosphorothioate
  modified_base 22: mod_base = OTHER; note = 2'-O-methyluridine-3'-phosphorothioate
  modified_base 23: mod_base = OTHER; note = 2'-O-methyluridine
ttatagagcaagaacactgtttt

SEQ ID NO: 358 - RNA, 23 nt, synthetic construct
  source 1..23: mol_type = other RNA
  modified_base 1: mod_base = OTHER; note = 2'-O-methyluridine-3'-phosphorothioate
  modified_base 2: mod_base = OTHER; note = 2'-deoxy-2'-fluorouridine-3'-phosphorothioate
  modified_base 3: mod_base = OTHER; note = 2'-O-methyladenosine-3'-phosphate
  modified_base 4: mod_base = OTHER; note = 2'-deoxy-2'-fluorouridine-3'-phosphate
  modified_base 5: mod_base = OTHER; note = 2'-O-methyladenosine-3'-phosphate
  modified_base 6: mod_base = OTHER; note = 2'-deoxy-2'-fluoroguanosine-3'-phosphate
  modified_base 7: mod_base = OTHER; note = 2'-O-methyladenosine-3'-phosphate
  modified_base 8: mod_base = OTHER; note = 2'-deoxy-2'-fluoroguanosine-3'-phosphate
  modified_base 9: mod_base = OTHER; note = 2'-O-methylcytidine-3'-phosphate
  modified_base 10: mod_base = OTHER; note = 2'-deoxy-2'-fluoroadenosine-3'-phosphate
  modified_base 11: mod_base = OTHER; note = 2'-O-methyladenosine-3'-phosphate
  modified_base 12: mod_base = OTHER; note = 2'-O-methylguanosine-3'-phosphate
  modified_base 13: mod_base = OTHER; note = 2'-O-methyladenosine-3'-phosphate
  modified_base 14: mod_base = OTHER; note = 2'-deoxy-2'-fluoroadenosine-3'-phosphate
  modified_base 15: mod_base = OTHER; note = 2'-O-methylcytidine-3'-phosphate
  modified_base 16: mod_base = OTHER; note = 2'-deoxy-2'-fluoroadenosine-3'-phosphate
  modified_base 17: mod_base = OTHER; note = 2'-O-methylcytidine-3'-phosphate
  modified_base 18: mod_base = OTHER; note = 2'-deoxy-2'-fluorouridine-3'-phosphate
  modified_base 19: mod_base = OTHER; note = 2'-O-methylguanosine-3'-phosphate
  modified_base 20: mod_base = OTHER; note = 2'-deoxy-2'-fluorouridine-3'-phosphate
  modified_base 21: mod_base = OTHER; note = 2'-O-methyluridine-3'-phosphorothioate
  modified_base 22: mod_base = OTHER; note = 2'-O-methyluridine-3'-phosphorothioate
  modified_base 23: mod_base = OTHER; note = 2'-O-methyluridine
ttatagagcaagaacactgtttt

SEQ ID NO: 359 - RNA, 23 nt, synthetic construct
  source 1..23: mol_type = other RNA
  modified_base 1: mod_base = OTHER; note = 2'-O-methyluridine-3'-phosphorothioate
  modified_base 2: mod_base = OTHER; note = 2'-deoxy-2'-fluorouridine-3'-phosphorothioate
  modified_base 3: mod_base = OTHER; note = 2'-O-methyladenosine-3'-phosphate
  modified_base 4: mod_base = OTHER; note = 2'-deoxy-2'-fluorouridine-3'-phosphate
  modified_base 5: mod_base = OTHER; note = 2'-O-methyladenosine-3'-phosphate
  modified_base 6: mod_base = OTHER; note = 2'-deoxy-2'-fluoroguanosine-3'-phosphate
  modified_base 7: mod_base = OTHER; note = 2'-O-methyladenosine-3'-phosphate
  modified_base 8: mod_base = OTHER; note = 2'-deoxy-2'-fluoroguanosine-3'-phosphate
  modified_base 9: mod_base = OTHER; note = 2'-O-methylcytidine-3'-phosphate
  modified_base 10: mod_base = OTHER; note = 2'-deoxy-2'-fluoroadenosine-3'-phosphate
  modified_base 11: mod_base = OTHER; note = 2'-O-methyladenosine-3'-phosphate
  modified_base 12: mod_base = OTHER; note = 2'-O-methylguanosine-3'-phosphate
  modified_base 13: mod_base = OTHER; note = 2'-O-methyladenosine-3'-phosphate
  modified_base 14: mod_base = OTHER; note = 2'-deoxy-2'-fluoroadenosine-3'-phosphate
  modified_base 15: mod_base = OTHER; note = 2'-O-methylcytidine-3'-phosphate
  modified_base 16: mod_base = OTHER; note = 2'-deoxy-2'-fluoroadenosine-3'-phosphate
  modified_base 17: mod_base = OTHER; note = 2'-O-methylcytidine-3'-phosphate
  modified_base 18: mod_base = OTHER; note = 2'-deoxy-2'-fluorouridine-3'-phosphate
  modified_base 19: mod_base = OTHER; note = 2'-O-methylguanosine-3'-phosphate
  modified_base 20: mod_base = OTHER; note = 2'-deoxy-2'-fluorouridine-3'-phosphate
  modified_base 21: mod_base = OTHER; note = 2'-O-methyluridine-3'-phosphorothioate
  modified_base 22: mod_base = OTHER; note = 2'-O-methyluridine-3'-phosphorothioate
  modified_base 23: mod_base = OTHER; note = 2'-O-methyluridine
ttatagagcaagaacactgtttt

SEQ ID NO: 360 - RNA, 23 nt, synthetic construct
  source 1..23: mol_type = other RNA
  modified_base 1: mod_base = OTHER; note = 2'-O-methyluridine-3'-phosphorothioate
  modified_base 2: mod_base = OTHER; note = 2'-deoxy-2'-fluorouridine-3'-phosphorothioate
  modified_base 3: mod_base = OTHER; note = 2'-O-methyladenosine-3'-phosphate
  modified_base 4: mod_base = OTHER; note = 2'-deoxy-2'-fluorouridine-3'-phosphate
  modified_base 5: mod_base = OTHER; note = 2'-O-methyladenosine-3'-phosphate
  modified_base 6: mod_base = OTHER; note = 2'-deoxy-2'-fluoroguanosine-3'-phosphate
  modified_base 7: mod_base = OTHER; note = 2'-O-methyladenosine-3'-phosphate
  modified_base 8: mod_base = OTHER; note = 2'-deoxy-2'-fluoroguanosine-3'-phosphate
  modified_base 9: mod_base = OTHER; note = 2'-O-methylcytidine-3'-phosphate
  modified_base 10: mod_base = OTHER; note = 2'-deoxy-2'-fluoroadenosine-3'-phosphate
  modified_base 11: mod_base = OTHER; note = 2'-O-methyladenosine-3'-phosphate
  modified_base 12: mod_base = OTHER; note = 2'-O-methylguanosine-3'-phosphate
  modified_base 13: mod_base = OTHER; note = 2'-O-methyladenosine-3'-phosphate
  modified_base 14: mod_base = OTHER; note = 2'-deoxy-2'-fluoroadenosine-3'-phosphate
  modified_base 15: mod_base = OTHER; note = 2'-O-methylcytidine-3'-phosphate
  modified_base 16: mod_base = OTHER; note = 2'-deoxy-2'-fluoroadenosine-3'-phosphate
  modified_base 17: mod_base = OTHER; note = 2'-O-methylcytidine-3'-phosphate
  modified_base 18: mod_base = OTHER; note = 2'-deoxy-2'-fluorouridine-3'-phosphate
  modified_base 19: mod_base = OTHER; note = 2'-O-methylguanosine-3'-phosphate
  modified_base 20: mod_base = OTHER; note = 2'-deoxy-2'-fluorouridine-3'-phosphate
  modified_base 21: mod_base = OTHER; note = 2'-O-methyluridine-3'-phosphorothioate
  modified_base 22: mod_base = OTHER; note = 2'-O-methyluridine-3'-phosphorothioate
  modified_base 23: mod_base = OTHER; note = 2'-O-methyluridine
ttatagagcaagaacactgtttt

SEQ ID NO: 361 - RNA, 23 nt, synthetic construct
  source 1..23: mol_type = other RNA
  modified_base 1: mod_base = OTHER; note = 2'-O-methyluridine-3'-phosphorothioate
  modified_base 2: mod_base = OTHER; note = 2'-deoxy-2'-fluorouridine-3'-phosphorothioate
  modified_base 3: mod_base = OTHER; note = 2'-O-methyladenosine-3'-phosphate
  modified_base 4: mod_base = OTHER; note = 2'-deoxy-2'-fluorouridine-3'-phosphate
  modified_base 5: mod_base = OTHER; note = 2'-O-methyladenosine-3'-phosphate
  modified_base 6: mod_base = OTHER; note = 2'-deoxy-2'-fluoroguanosine-3'-phosphate
  modified_base 7: mod_base = OTHER; note = 2'-O-methyladenosine-3'-phosphate
  modified_base 8: mod_base = OTHER; note = 2'-deoxy-2'-fluoroguanosine-3'-phosphate
  modified_base 9: mod_base = OTHER; note = 2'-O-methylcytidine-3'-phosphate
  modified_base 10: mod_base = OTHER; note = 2'-deoxy-2'-fluoroadenosine-3'-phosphate
  modified_base 11: mod_base = OTHER; note = 2'-O-methyladenosine-3'-phosphate
  modified_base 12: mod_base = OTHER; note = 2'-O-methylguanosine-3'-phosphate
  modified_base 13: mod_base = OTHER; note = 2'-O-methyladenosine-3'-phosphate
  modified_base 14: mod_base = OTHER; note = 2'-deoxy-2'-fluoroadenosine-3'-phosphate
  modified_base 15: mod_base = OTHER; note = 2'-O-methylcytidine-3'-phosphate
  modified_base 16: mod_base = OTHER; note = 2'-deoxy-2'-fluoroadenosine-3'-phosphate
  modified_base 17: mod_base = OTHER; note = 2'-O-methylcytidine-3'-phosphate
  modified_base 18: mod_base = OTHER; note = 2'-deoxy-2'-fluorouridine-3'-phosphate
  modified_base 19: mod_base = OTHER; note = 2'-O-methylguanosine-3'-phosphate
  modified_base 20: mod_base = OTHER; note = 2'-deoxy-2'-fluorouridine-3'-phosphate
  modified_base 21: mod_base = OTHER; note = 2'-O-methyluridine-3'-phosphorothioate
  modified_base 22: mod_base = OTHER; note = 2'-O-methyluridine-3'-phosphorothioate
  modified_base 23: mod_base = OTHER; note = 2'-O-methyluridine
ttatagagcaagaacactgtttt

SEQ ID NO: 362 - RNA, 23 nt, synthetic construct
  source 1..23: mol_type = other RNA
  modified_base 1: mod_base = OTHER; note = 2'-O-methyluridine-3'-phosphorothioate
  modified_base 2: mod_base = OTHER; note = 2'-deoxy-2'-fluorouridine-3'-phosphorothioate
  modified_base 3: mod_base = OTHER; note = 2'-O-methyladenosine-3'-phosphate
  modified_base 4: mod_base = OTHER; note = 2'-deoxy-2'-fluorouridine-3'-phosphate
  modified_base 5: mod_base = OTHER; note = 2'-O-methyladenosine-3'-phosphate
  modified_base 6: mod_base = OTHER; note = 2'-deoxy-2'-fluoroguanosine-3'-phosphate
  modified_base 7: mod_base = OTHER; note = 2'-O-methyladenosine-3'-phosphate
  modified_base 8: mod_base = OTHER; note = 2'-deoxy-2'-fluoroguanosine-3'-phosphate
  modified_base 9: mod_base = OTHER; note = 2'-O-methylcytidine-3'-phosphate
  modified_base 10: mod_base = OTHER; note = 2'-deoxy-2'-fluoroadenosine-3'-phosphate
  modified_base 11: mod_base = OTHER; note = 2'-O-methyladenosine-3'-phosphate
  modified_base 12: mod_base = OTHER; note = 2'-O-methylguanosine-3'-phosphate
  modified_base 13: mod_base = OTHER; note = 2'-O-methyladenosine-3'-phosphate
  modified_base 14: mod_base = OTHER; note = 2'-deoxy-2'-fluoroadenosine-3'-phosphate
  modified_base 15: mod_base = OTHER; note = 2'-O-methylcytidine-3'-phosphate
  modified_base 16: mod_base = OTHER; note = 2'-deoxy-2'-fluoroadenosine-3'-phosphate
  modified_base 17: mod_base = OTHER; note = 2'-O-methylcytidine-3'-phosphate
  modified_base 18: mod_base = OTHER; note = 2'-deoxy-2'-fluorouridine-3'-phosphate
  modified_base 19: mod_base = OTHER; note = 2'-O-methylguanosine-3'-phosphate
  modified_base 20: mod_base = OTHER; note = 2'-deoxy-2'-fluorouridine-3'-phosphate
  modified_base 21: mod_base = OTHER; note = 2'-O-methyluridine-3'-phosphorothioate
  modified_base 22: mod_base = OTHER; note = 2'-O-methyluridine-3'-phosphorothioate
  modified_base 23: mod_base = OTHER; note = 2'-O-methyluridine
ttatagagcaagaacactgtttt

SEQ ID NO: 363 - RNA, 23 nt, synthetic construct
  source 1..23: mol_type = other RNA
  modified_base 1: mod_base = OTHER; note = 2'-O-methyluridine-3'-phosphorothioate
  modified_base 2: mod_base = OTHER; note = 2'-deoxy-2'-fluorouridine-3'-phosphorothioate
  modified_base 3: mod_base = OTHER; note = 2'-O-methyladenosine-3'-phosphate
  modified_base 4: mod_base = OTHER; note = 2'-deoxy-2'-fluorouridine-3'-phosphate
  modified_base 5: mod_base = OTHER; note = 2'-O-methyladenosine-3'-phosphate
  modified_base 6: mod_base = OTHER; note = 2'-deoxy-2'-fluoroguanosine-3'-phosphate
  modified_base 7: mod_base = OTHER; note = 2'-O-methyladenosine-3'-phosphate
  modified_base 8: mod_base = OTHER; note = 2'-deoxy-2'-fluoroguanosine-3'-phosphate
  modified_base 9: mod_base = OTHER; note = 2'-O-methylcytidine-3'-phosphate
  modified_base 10: mod_base = OTHER; note = 2'-deoxy-2'-fluoroadenosine-3'-phosphate
  modified_base 11: mod_base = OTHER; note = 2'-O-methyladenosine-3'-phosphate
  modified_base 12: mod_base = OTHER; note = 2'-O-methylguanosine-3'-phosphate
  modified_base 13: mod_base = OTHER; note = 2'-O-methyladenosine-3'-phosphate
  modified_base 14: mod_base = OTHER; note = 2'-deoxy-2'-fluoroadenosine-3'-phosphate
  modified_base 15: mod_base = OTHER; note = 2'-O-methylcytidine-3'-phosphate
  modified_base 16: mod_base = OTHER; note = 2'-deoxy-2'-fluoroadenosine-3'-phosphate
  modified_base 17: mod_base = OTHER; note = 2'-O-methylcytidine-3'-phosphate
  modified_base 18: mod_base = OTHER; note = 2'-deoxy-2'-fluorouridine-3'-phosphate
  modified_base 19: mod_base = OTHER; note = 2'-O-methylguanosine-3'-phosphate
  modified_base 20: mod_base = OTHER; note = 2'-deoxy-2'-fluorouridine-3'-phosphate
  modified_base 21: mod_base = OTHER; note = 2'-O-methyluridine-3'-phosphorothioate
  modified_base 22: mod_base = OTHER; note = 2'-O-methyluridine-3'-phosphorothioate
  modified_base 23: mod_base = OTHER; note = 2'-O-methyluridine
ttatagagcaagaacactgtttt

SEQ ID NO: 364 - RNA, 23 nt, synthetic construct
  source 1..23: mol_type = other RNA
  modified_base 1: mod_base = OTHER; note = 2'-O-methyluridine-3'-phosphorothioate
  modified_base 2: mod_base = OTHER; note = 2'-deoxy-2'-fluorouridine-3'-phosphorothioate
  modified_base 3: mod_base = OTHER; note = 2'-O-methyladenosine-3'-phosphate
  modified_base 4: mod_base = OTHER; note = 2'-deoxy-2'-fluorouridine-3'-phosphate
  modified_base 5: mod_base = OTHER; note = 2'-O-methyladenosine-3'-phosphate
  modified_base 6: mod_base = OTHER; note = 2'-deoxy-2'-fluoroguanosine-3'-phosphate
  modified_base 7: mod_base = OTHER; note = 2'-O-methyladenosine-3'-phosphate
  modified_base 8: mod_base = OTHER; note = 2'-deoxy-2'-fluoroguanosine-3'-phosphate
  modified_base 9: mod_base = OTHER; note = 2'-O-methylcytidine-3'-phosphate
  modified_base 10: mod_base = OTHER; note = 2'-deoxy-2'-fluoroadenosine-3'-phosphate
  modified_base 11: mod_base = OTHER; note = 2'-O-methyladenosine-3'-phosphate
  modified_base 12: mod_base = OTHER; note = 2'-O-methylguanosine-3'-phosphate
  modified_base 13: mod_base = OTHER; note = 2'-O-methyladenosine-3'-phosphate
  modified_base 14: mod_base = OTHER; note = 2'-deoxy-2'-fluoroadenosine-3'-phosphate
  modified_base 15: mod_base = OTHER; note = 2'-O-methylcytidine-3'-phosphate
  modified_base 16: mod_base = OTHER; note = 2'-deoxy-2'-fluoroadenosine-3'-phosphate
  modified_base 17: mod_base = OTHER; note = 2'-O-methylcytidine-3'-phosphate
  modified_base 18: mod_base = OTHER; note = 2'-deoxy-2'-fluorouridine-3'-phosphate
  modified_base 19: mod_base = OTHER; note = 2'-O-methylguanosine-3'-phosphate
  modified_base 20: mod_base = OTHER; note = 2'-deoxy-2'-fluorouridine-3'-phosphate
  modified_base 21: mod_base = OTHER; note = 2'-O-methyluridine-3'-phosphorothioate
  modified_base 22: mod_base = OTHER; note = 2'-O-methyluridine-3'-phosphorothioate
  modified_base 23: mod_base = OTHER; note = 2'-O-methyluridine
ttatagagcaagaacactgtttt

SEQ ID NO: 365 - RNA, 23 nt, synthetic construct
  source 1..23: mol_type = other RNA
  modified_base 1: mod_base = OTHER; note = 2'-O-methyluridine-3'-phosphorothioate
  modified_base 2: mod_base = OTHER; note = 2'-deoxy-2'-fluorouridine-3'-phosphorothioate
  modified_base 3: mod_base = OTHER; note = 2'-O-methyladenosine-3'-phosphate
  modified_base 4: mod_base = OTHER; note = 2'-deoxy-2'-fluorouridine-3'-phosphate
  modified_base 5: mod_base = OTHER; note = 2'-O-methyladenosine-3'-phosphate
  modified_base 6: mod_base = OTHER; note = 2'-deoxy-2'-fluoroguanosine-3'-phosphate
  modified_base 7: mod_base = OTHER; note = 2'-O-methyladenosine-3'-phosphate
  modified_base 8: mod_base = OTHER; note = 2'-deoxy-2'-fluoroguanosine-3'-phosphate
  modified_base 9: mod_base = OTHER; note = 2'-O-methylcytidine-3'-phosphate
  modified_base 10: mod_base = OTHER; note = 2'-deoxy-2'-fluoroadenosine-3'-phosphate
  modified_base 11: mod_base = OTHER; note = 2'-O-methyladenosine-3'-phosphate
  modified_base 12: mod_base = OTHER; note = 2'-O-methylguanosine-3'-phosphate
  modified_base 13: mod_base = OTHER; note = 2'-O-methyladenosine-3'-phosphate
  modified_base 14: mod_base = OTHER; note = 2'-deoxy-2'-fluoroadenosine-3'-phosphate
  modified_base 15: mod_base = OTHER; note = 2'-O-methylcytidine-3'-phosphate
  modified_base 16: mod_base = OTHER; note = 2'-deoxy-2'-fluoroadenosine-3'-phosphate
  modified_base 17: mod_base = OTHER; note = 2'-O-methylcytidine-3'-phosphate
  modified_base 18: mod_base = OTHER; note = 2'-deoxy-2'-fluorouridine-3'-phosphate
  modified_base 19: mod_base = OTHER; note = 2'-O-methylguanosine-3'-phosphate
  modified_base 20: mod_base = OTHER; note = 2'-deoxy-2'-fluorouridine-3'-phosphate
  modified_base 21: mod_base = OTHER; note = 2'-O-methyluridine-3'-phosphorothioate
  modified_base 22: mod_base = OTHER; note = 2'-O-methyluridine-3'-phosphorothioate
  modified_base 23: mod_base = OTHER; note = 2'-O-methyluridine
ttatagagcaagaacactgtttt

SEQ ID NO: 366 - RNA, 23 nt, synthetic construct
  source 1..23: mol_type = other RNA
  modified_base 1: mod_base = OTHER; note = 2'-O-methyluridine-3'-phosphorothioate
  modified_base 2: mod_base = OTHER; note = 2'-deoxy-2'-fluorouridine-3'-phosphorothioate
  modified_base 3: mod_base = OTHER; note = 2'-O-methyladenosine-3'-phosphate
  modified_base 4: mod_base = OTHER; note = 2'-deoxy-2'-fluorouridine-3'-phosphate
  modified_base 5: mod_base = OTHER; note = 2'-O-methyladenosine-3'-phosphate
  modified_base 6: mod_base = OTHER; note = 2'-deoxy-2'-fluoroguanosine-3'-phosphate
  modified_base 7: mod_base = OTHER; note = 2'-O-methyladenosine-3'-phosphate
  modified_base 8: mod_base = OTHER; note = 2'-deoxy-2'-fluoroguanosine-3'-phosphate
  modified_base 9: mod_base = OTHER; note = 2'-O-methylcytidine-3'-phosphate
  modified_base 10: mod_base = OTHER; note = 2'-deoxy-2'-fluoroadenosine-3'-phosphate
  modified_base 11: mod_base = OTHER; note = 2'-O-methyladenosine-3'-phosphate
  modified_base 12: mod_base = OTHER; note = 2'-O-methylguanosine-3'-phosphate
  modified_base 13: mod_base = OTHER; note = 2'-O-methyladenosine-3'-phosphate
  modified_base 14: mod_base = OTHER; note = 2'-deoxy-2'-fluoroadenosine-3'-phosphate
  modified_base 15: mod_base = OTHER; note = 2'-O-methylcytidine-3'-phosphate
  modified_base 16: mod_base = OTHER; note = 2'-deoxy-2'-fluoroadenosine-3'-phosphate
  modified_base 17: mod_base = OTHER; note = 2'-O-methylcytidine-3'-phosphate
  modified_base 18: mod_base = OTHER; note = 2'-deoxy-2'-fluorouridine-3'-phosphate
  modified_base 19: mod_base = OTHER; note = 2'-O-methylguanosine-3'-phosphate
  modified_base 20: mod_base = OTHER; note = 2'-deoxy-2'-fluorouridine-3'-phosphate
  modified_base 21: mod_base = OTHER; note = 2'-O-methyluridine-3'-phosphorothioate
  modified_base 22: mod_base = OTHER; note = 2'-O-methyluridine-3'-phosphorothioate
  modified_base 23: mod_base = OTHER; note = 2'-O-methyluridine
ttatagagcaagaacactgtttt

SEQ ID NO: 367 - RNA, 21 nt, synthetic construct
  source 1..21: mol_type = other RNA
  modified_base 1: mod_base = OTHER; note = 2'-deoxy-2'-fluoroadenosine-3'-phosphorothioate
  modified_base 2: mod_base = OTHER; note = 2'-O-methyladenosine-3'-phosphorothioate
  modified_base 3: mod_base = OTHER; note = 2'-deoxy-2'-fluorocytidine-3'-phosphate
  modified_base 4: mod_base = OTHER; note = 2'-O-methyladenosine-3'-phosphate
  modified_base 5: mod_base = OTHER; note = 2'-deoxy-2'-fluoroguanosine-3'-phosphate
  modified_base 6: mod_base = OTHER; note = 2'-O-methyluridine-3'-phosphate
  modified_base 7: mod_base = OTHER; note = 2'-deoxy-2'-fluoroguanosine-3'-phosphate
  modified_base 8: mod_base = OTHER; note = 2'-O-methyluridine-3'-phosphate
  modified_base 9: mod_base = OTHER; note = 2'-deoxy-2'-fluorouridine-3'-phosphate
  modified_base 10: mod_base = OTHER; note = 2'-deoxy-2'-fluorocytidine-3'-phosphate
  modified_base 11: mod_base = OTHER; note = 2'-deoxy-2'-fluorouridine-3'-phosphate
  modified_base 12: mod_base = OTHER; note = 2'-O-methyluridine-3'-phosphate
  modified_base 13: mod_base = OTHER; note = 2'-deoxy-2'-fluoroguanosine-3'-phosphate
  modified_base 14: mod_base = OTHER; note = 2'-O-methylcytidine-3'-phosphate
  modified_base 15: mod_base = OTHER; note = 2'-deoxy-2'-fluorouridine-3'-phosphate
  modified_base 16: mod_base = OTHER; note = 2'-O-methylcytidine-3'-phosphate
  modified_base 17: mod_base = OTHER; note = 2'-deoxy-2'-fluorouridine-3'-phosphate
  modified_base 18: mod_base = OTHER; note = 2'-O-methyladenosine-3'-phosphate
  modified_base 19: mod_base = OTHER; note = 2'-deoxy-2'-fluorouridine-3'-phosphate
  modified_base 20: mod_base = OTHER; note = 2'-O-methyladenosine-3'-phosphate
  modified_base 21: mod_base = OTHER; note = 2'-deoxy-2'-fluoroadenosine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
aacagtgttcttgctctataa

SEQ ID NO: 368 - RNA, 21 nt, synthetic construct
  source 1..21: mol_type = other RNA
  modified_base 1: mod_base = OTHER; note = 2'-deoxy-2'-fluoroadenosine-3'-phosphorothioate
  modified_base 2: mod_base = OTHER; note = 2'-O-methyladenosine-3'-phosphorothioate
  modified_base 3: mod_base = OTHER; note = 2'-deoxy-2'-fluorocytidine-3'-phosphate
  modified_base 4: mod_base = OTHER; note = 2'-O-methyladenosine-3'-phosphate
  modified_base 5: mod_base = OTHER; note = 2'-deoxy-2'-fluoroguanosine-3'-phosphate
  modified_base 6: mod_base = OTHER; note = 2'-O-methyluridine-3'-phosphate
  modified_base 7: mod_base = OTHER; note = 2'-deoxy-2'-fluoroguanosine-3'-phosphate
  modified_base 8: mod_base = OTHER; note = 2'-O-methyluridine-3'-phosphate
  modified_base 9: mod_base = OTHER; note = 2'-deoxy-2'-fluorouridine-3'-phosphate
  modified_base 10: mod_base = OTHER; note = 2'-deoxy-2'-fluorocytidine-3'-phosphate
  modified_base 11: mod_base = OTHER; note = 2'-deoxy-2'-fluorouridine-3'-phosphate
  modified_base 12: mod_base = OTHER; note = 2'-O-methyluridine-3'-phosphate
  modified_base 13: mod_base = OTHER; note = 2'-deoxy-2'-fluoroguanosine-3'-phosphate
  modified_base 14: mod_base = OTHER; note = 2'-O-methylcytidine-3'-phosphate
  modified_base 15: mod_base = OTHER; note = 2'-deoxy-2'-fluorouridine-3'-phosphate
  modified_base 16: mod_base = OTHER; note = 2'-O-methylcytidine-3'-phosphate
  modified_base 17: mod_base = OTHER; note = 2'-deoxy-2'-fluorouridine-3'-phosphate
  modified_base 18: mod_base = OTHER; note = 2'-O-methyladenosine-3'-phosphate
  modified_base 19: mod_base = OTHER; note = 2'-deoxy-2'-fluorouridine-3'-phosphate
  modified_base 20: mod_base = OTHER; note = 2'-O-methyladenosine-3'-phosphate
  modified_base 21: mod_base = OTHER; note = Adenosine-glycol nucleic acid (GNA), S-isomer ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
aacagtgttcttgctctataa

SEQ ID NO: 369 - RNA, 21 nt, synthetic construct
  source 1..21: mol_type = other RNA
  modified_base 1: mod_base = OTHER; note = 2'-deoxy-2'-fluoroadenosine-3'-phosphorothioate
  modified_base 2: mod_base = OTHER; note = 2'-O-methyladenosine-3'-phosphorothioate
  modified_base 3: mod_base = OTHER; note = 2'-deoxy-2'-fluorocytidine-3'-phosphate
  modified_base 4: mod_base = OTHER; note = 2'-O-methyladenosine-3'-phosphate
  modified_base 5: mod_base = OTHER; note = 2'-deoxy-2'-fluoroguanosine-3'-phosphate
  modified_base 6: mod_base = OTHER; note = 2'-O-methyluridine-3'-phosphate
  modified_base 7: mod_base = OTHER; note = 2'-deoxy-2'-fluoroguanosine-3'-phosphate
  modified_base 8: mod_base = OTHER; note = 2'-O-methyluridine-3'-phosphate
  modified_base 9: mod_base = OTHER; note = 2'-deoxy-2'-fluorouridine-3'-phosphate
  modified_base 10: mod_base = OTHER; note = 2'-deoxy-2'-fluorocytidine-3'-phosphate
  modified_base 11: mod_base = OTHER; note = 2'-deoxy-2'-fluorouridine-3'-phosphate
  modified_base 12: mod_base = OTHER; note = 2'-O-methyluridine-3'-phosphate
  modified_base 13: mod_base = OTHER; note = 2'-deoxy-2'-fluoroguanosine-3'-phosphate
  modified_base 14: mod_base = OTHER; note = 2'-O-methylcytidine-3'-phosphate
  modified_base 15: mod_base = OTHER; note = 2'-deoxy-2'-fluorouridine-3'-phosphate
  modified_base 16: mod_base = OTHER; note = 2'-O-methylcytidine-3'-phosphate
  modified_base 17: mod_base = OTHER; note = 2'-deoxy-2'-fluorouridine-3'-phosphate
  modified_base 18: mod_base = OTHER; note = 2'-O-methyladenosine-3'-phosphate
  modified_base 19: mod_base = OTHER; note = 2'-deoxy-2'-fluorouridine-3'-phosphate
  modified_base 20: mod_base = OTHER; note = Adenosine-glycol nucleic acid (GNA), S-isomer
  modified_base 21: mod_base = OTHER; note = 2'-deoxy-2'-fluoroadenosine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
aacagtgttcttgctctataa

SEQ ID NO: 370 - RNA, 21 nt, synthetic construct
  source 1..21: mol_type = other RNA
  modified_base 1: mod_base = OTHER; note = 2'-deoxy-2'-fluoroadenosine-3'-phosphorothioate
  modified_base 2: mod_base = OTHER; note = 2'-O-methyladenosine-3'-phosphorothioate
  modified_base 3: mod_base = OTHER; note = 2'-deoxy-2'-fluorocytidine-3'-phosphate
  modified_base 4: mod_base = OTHER; note = 2'-O-methyladenosine-3'-phosphate
  modified_base 5: mod_base = OTHER; note = 2'-deoxy-2'-fluoroguanosine-3'-phosphate
  modified_base 6: mod_base = OTHER; note = 2'-O-methyluridine-3'-phosphate
  modified_base 7: mod_base = OTHER; note = 2'-deoxy-2'-fluoroguanosine-3'-phosphate
  modified_base 8: mod_base = OTHER; note = 2'-O-methyluridine-3'-phosphate
  modified_base 9: mod_base = OTHER; note = 2'-deoxy-2'-fluorouridine-3'-phosphate
  modified_base 10: mod_base = OTHER; note = 2'-deoxy-2'-fluorocytidine-3'-phosphate
  modified_base 11: mod_base = OTHER; note = 2'-deoxy-2'-fluorouridine-3'-phosphate
  modified_base 12: mod_base = OTHER; note = 2'-O-methyluridine-3'-phosphate
  modified_base 13: mod_base = OTHER; note = 2'-deoxy-2'-fluoroguanosine-3'-phosphate
  modified_base 14: mod_base = OTHER; note = 2'-O-methylcytidine-3'-phosphate
  modified_base 15: mod_base = OTHER; note = 2'-deoxy-2'-fluorouridine-3'-phosphate
  modified_base 16: mod_base = OTHER; note = 2'-O-methylcytidine-3'-phosphate
  modified_base 17: mod_base = OTHER; note = 2'-deoxy-2'-fluorouridine-3'-phosphate
  modified_base 18: mod_base = OTHER; note = 2'-O-methyladenosine-3'-phosphate
  modified_base 19: mod_base = OTHER; note = Thymidine-glycol nucleic acid (GNA), S-Isomer
  modified_base 20: mod_base = OTHER; note = 2'-O-methyladenosine-3'-phosphate
  modified_base 21: mod_base = OTHER; note = 2'-deoxy-2'-fluoroadenosine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
aacagtgttcttgctctataa

SEQ ID NO: 371 - RNA, 21 nt, synthetic construct
  source 1..21: mol_type = other RNA
  modified_base 1: mod_base = OTHER; note = 2'-deoxy-2'-fluoroadenosine-3'-phosphorothioate
  modified_base 2: mod_base = OTHER; note = 2'-O-methyladenosine-3'-phosphorothioate
  modified_base 3: mod_base = OTHER; note = 2'-deoxy-2'-fluorocytidine-3'-phosphate
  modified_base 4: mod_base = OTHER; note = 2'-O-methyladenosine-3'-phosphate
  modified_base 5: mod_base = OTHER; note = 2'-deoxy-2'-fluoroguanosine-3'-phosphate
  modified_base 6: mod_base = OTHER; note = 2'-O-methyluridine-3'-phosphate
  modified_base 7: mod_base = OTHER; note = 2'-deoxy-2'-fluoroguanosine-3'-phosphate
  modified_base 8: mod_base = OTHER; note = 2'-O-methyluridine-3'-phosphate
  modified_base 9: mod_base = OTHER; note = 2'-deoxy-2'-fluorouridine-3'-phosphate
  modified_base 10: mod_base = OTHER; note = 2'-deoxy-2'-fluorocytidine-3'-phosphate
  modified_base 11: mod_base = OTHER; note = 2'-deoxy-2'-fluorouridine-3'-phosphate
  modified_base 12: mod_base = OTHER; note = 2'-O-methyluridine-3'-phosphate
  modified_base 13: mod_base = OTHER; note = 2'-deoxy-2'-fluoroguanosine-3'-phosphate
  modified_base 14: mod_base = OTHER; note = 2'-O-methylcytidine-3'-phosphate
  modified_base 15: mod_base = OTHER; note = 2'-deoxy-2'-fluorouridine-3'-phosphate
  modified_base 16: mod_base = OTHER; note = 2'-O-methylcytidine-3'-phosphate
  modified_base 17: mod_base = OTHER; note = 2'-deoxy-2'-fluorouridine-3'-phosphate
  modified_base 18: mod_base = OTHER; note = Adenosine-glycol nucleic acid (GNA), S-isomer
  modified_base 19: mod_base = OTHER; note = 2'-deoxy-2'-fluorouridine-3'-phosphate
  modified_base 20: mod_base = OTHER; note = 2'-O-methyladenosine-3'-phosphate
  modified_base 21: mod_base = OTHER; note = 2'-deoxy-2'-fluoroadenosine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
aacagtgttcttgctctataa

SEQ ID NO: 372 - RNA, 21 nt, synthetic construct
  source 1..21: mol_type = other RNA
  modified_base 1: mod_base = OTHER; note = 2'-deoxy-2'-fluoroadenosine-3'-phosphorothioate
  modified_base 2: mod_base = OTHER; note = 2'-O-methyladenosine-3'-phosphorothioate
  modified_base 3: mod_base = OTHER; note = 2'-deoxy-2'-fluorocytidine-3'-phosphate
  modified_base 4: mod_base = OTHER; note = 2'-O-methyladenosine-3'-phosphate
  modified_base 5: mod_base = OTHER; note = 2'-deoxy-2'-fluoroguanosine-3'-phosphate
  modified_base 6: mod_base = OTHER; note = 2'-O-methyluridine-3'-phosphate
  modified_base 7: mod_base = OTHER; note = 2'-deoxy-2'-fluoroguanosine-3'-phosphate
  modified_base 8: mod_base = OTHER; note = 2'-O-methyluridine-3'-phosphate
  modified_base 9: mod_base = OTHER; note = 2'-deoxy-2'-fluorouridine-3'-phosphate
  modified_base 10: mod_base = OTHER; note = 2'-deoxy-2'-fluorocytidine-3'-phosphate
  modified_base 11: mod_base = OTHER; note = 2'-deoxy-2'-fluorouridine-3'-phosphate
  modified_base 12: mod_base = OTHER; note = 2'-O-methyluridine-3'-phosphate
  modified_base 13: mod_base = OTHER; note = 2'-deoxy-2'-fluoroguanosine-3'-phosphate
  modified_base 14: mod_base = OTHER; note = 2'-O-methylcytidine-3'-phosphate
  modified_base 15: mod_base = OTHER; note = 2'-deoxy-2'-fluorouridine-3'-phosphate
  modified_base 16: mod_base = OTHER; note = 2'-O-methylcytidine-3'-phosphate
  modified_base 17: mod_base = OTHER; note = Thymidine-glycol nucleic acid (GNA), S-Isomer
  modified_base 18: mod_base = OTHER; note = 2'-O-methyladenosine-3'-phosphate
  modified_base 19: mod_base = OTHER; note = 2'-deoxy-2'-fluorouridine-3'-phosphate
  modified_base 20: mod_base = OTHER; note = 2'-O-methyladenosine-3'-phosphate
  modified_base 21: mod_base = OTHER; note = 2'-deoxy-2'-fluoroadenosine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
aacagtgttcttgctctataa

SEQ ID NO: 373 - RNA, 21 nt, synthetic construct
  source 1..21: mol_type = other RNA
  modified_base 1: mod_base = OTHER; note = 2'-deoxy-2'-fluoroadenosine-3'-phosphorothioate
  modified_base 2: mod_base = OTHER; note = 2'-O-methyladenosine-3'-phosphorothioate
  modified_base 3: mod_base = OTHER; note = 2'-deoxy-2'-fluorocytidine-3'-phosphate
  modified_base 4: mod_base = OTHER; note = 2'-O-methyladenosine-3'-phosphate
  modified_base 5: mod_base = OTHER; note = 2'-deoxy-2'-fluoroguanosine-3'-phosphate
  modified_base 6: mod_base = OTHER; note = 2'-O-methyluridine-3'-phosphate
  modified_base 7: mod_base = OTHER; note = 2'-deoxy-2'-fluoroguanosine-3'-phosphate
  modified_base 8: mod_base = OTHER; note = 2'-O-methyluridine-3'-phosphate
  modified_base 9: mod_base = OTHER; note = 2'-deoxy-2'-fluorouridine-3'-phosphate
  modified_base 10: mod_base = OTHER; note = 2'-deoxy-2'-fluorocytidine-3'-phosphate
  modified_base 11: mod_base = OTHER; note = 2'-deoxy-2'-fluorouridine-3'-phosphate
  modified_base 12: mod_base = OTHER; note = 2'-O-methyluridine-3'-phosphate
  modified_base 13: mod_base = OTHER; note = 2'-deoxy-2'-fluoroguanosine-3'-phosphate
  modified_base 14: mod_base = OTHER; note = 2'-O-methylcytidine-3'-phosphate
  modified_base 15: mod_base = OTHER; note = 2'-deoxy-2'-fluorouridine-3'-phosphate
  modified_base 16: mod_base = OTHER; note = Cytidine-glycol nucleic acid (GNA), S-isomer
  modified_base 17: mod_base = OTHER; note = 2'-deoxy-2'-fluorouridine-3'-phosphate
  modified_base 18: mod_base = OTHER; note = 2'-O-methyladenosine-3'-phosphate
  modified_base 19: mod_base = OTHER; note = 2'-deoxy-2'-fluorouridine-3'-phosphate
  modified_base 20: mod_base = OTHER; note = 2'-O-methyladenosine-3'-phosphate
  modified_base 21: mod_base = OTHER; note = 2'-deoxy-2'-fluoroadenosine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
aacagtgttcttgctctataa

SEQ ID NO: 374 - RNA, 21 nt, synthetic construct
  source 1..21: mol_type = other RNA
  modified_base 1: mod_base = OTHER; note = 2'-deoxy-2'-fluoroadenosine-3'-phosphorothioate
  modified_base 2: mod_base = OTHER; note = 2'-O-methyladenosine-3'-phosphorothioate
  modified_base 3: mod_base = OTHER; note = 2'-deoxy-2'-fluorocytidine-3'-phosphate
  modified_base 4: mod_base = OTHER; note = 2'-O-methyladenosine-3'-phosphate
  modified_base 5: mod_base = OTHER; note = 2'-deoxy-2'-fluoroguanosine-3'-phosphate
  modified_base 6: mod_base = OTHER; note = 2'-O-methyluridine-3'-phosphate
  modified_base 7: mod_base = OTHER; note = 2'-deoxy-2'-fluoroguanosine-3'-phosphate
  modified_base 8: mod_base = OTHER; note = 2'-O-methyluridine-3'-phosphate
  modified_base 9: mod_base = OTHER; note = 2'-deoxy-2'-fluorouridine-3'-phosphate
  modified_base 10: mod_base = OTHER; note = 2'-deoxy-2'-fluorocytidine-3'-phosphate
  modified_base 11: mod_base = OTHER; note = 2'-deoxy-2'-fluorouridine-3'-phosphate
  modified_base 12: mod_base = OTHER; note = 2'-O-methyluridine-3'-phosphate
  modified_base 13: mod_base = OTHER; note = 2'-deoxy-2'-fluoroguanosine-3'-phosphate
  modified_base 14: mod_base = OTHER; note = 2'-O-methylcytidine-3'-phosphate
  modified_base 15: mod_base = OTHER; note = Thymidine-glycol nucleic acid (GNA), S-Isomer
  modified_base 16: mod_base = OTHER; note = 2'-O-methylcytidine-3'-phosphate
  modified_base 17: mod_base = OTHER; note = 2'-deoxy-2'-fluorouridine-3'-phosphate
  modified_base 18: mod_base = OTHER; note = 2'-O-methyladenosine-3'-phosphate
  modified_base 19: mod_base = OTHER; note = 2'-deoxy-2'-fluorouridine-3'-phosphate
  modified_base 20: mod_base = OTHER; note = 2'-O-methyladenosine-3'-phosphate
  modified_base 21: mod_base = OTHER; note = 2'-deoxy-2'-fluoroadenosine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
aacagtgttcttgctctataa

SEQ ID NO: 375 - RNA, 21 nt, synthetic construct
  source 1..21: mol_type = other RNA
  modified_base 1: mod_base = OTHER; note = 2'-deoxy-2'-fluoroadenosine-3'-phosphorothioate
  modified_base 2: mod_base = OTHER; note = 2'-O-methyladenosine-3'-phosphorothioate
  modified_base 3: mod_base = OTHER; note = 2'-deoxy-2'-fluorocytidine-3'-phosphate
  modified_base 4: mod_base = OTHER; note = 2'-O-methyladenosine-3'-phosphate
  modified_base 5: mod_base = OTHER; note = 2'-deoxy-2'-fluoroguanosine-3'-phosphate
  modified_base 6: mod_base = OTHER; note = 2'-O-methyluridine-3'-phosphate
  modified_base 7: mod_base = OTHER; note = 2'-deoxy-2'-fluoroguanosine-3'-phosphate
  modified_base 8: mod_base = OTHER; note = 2'-O-methyluridine-3'-phosphate
  modified_base 9: mod_base = OTHER; note = 2'-deoxy-2'-fluorouridine-3'-phosphate
  modified_base 10: mod_base = OTHER; note = 2'-deoxy-2'-fluorocytidine-3'-phosphate
  modified_base 11: mod_base = OTHER; note = 2'-deoxy-2'-fluorouridine-3'-phosphate
  modified_base 12: mod_base = OTHER; note = 2'-O-methyluridine-3'-phosphate
  modified_base 13: mod_base = OTHER; note = 2'-deoxy-2'-fluoroguanosine-3'-phosphate
  modified_base 14: mod_base = OTHER; note = Cytidine-glycol nucleic acid (GNA), S-isomer
  modified_base 15: mod_base = OTHER; note = 2'-deoxy-2'-fluorouridine-3'-phosphate
  modified_base 16: mod_base = OTHER; note = 2'-O-methylcytidine-3'-phosphate
  modified_base 17: mod_base = OTHER; note = 2'-deoxy-2'-fluorouridine-3'-phosphate
  modified_base 18: mod_base = OTHER; note = 2'-O-methyladenosine-3'-phosphate
  modified_base 19: mod_base = OTHER; note = 2'-deoxy-2'-fluorouridine-3'-phosphate
  modified_base 20: mod_base = OTHER; note = 2'-O-methyladenosine-3'-phosphate
  modified_base 21: mod_base = OTHER; note = 2'-deoxy-2'-fluoroadenosine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
aacagtgttcttgctctataa

SEQ ID NO: 376 - RNA, 21 nt, synthetic construct
  source 1..21: mol_type = other RNA
  modified_base 1: mod_base = OTHER; note = 2'-deoxy-2'-fluoroadenosine-3'-phosphorothioate
  modified_base 2: mod_base = OTHER; note = 2'-O-methyladenosine-3'-phosphorothioate
  modified_base 3: mod_base = OTHER; note = 2'-deoxy-2'-fluorocytidine-3'-phosphate
  modified_base 4: mod_base = OTHER; note = 2'-O-methyladenosine-3'-phosphate
  modified_base 5: mod_base = OTHER; note = 2'-deoxy-2'-fluoroguanosine-3'-phosphate
  modified_base 6: mod_base = OTHER; note = 2'-O-methyluridine-3'-phosphate
  modified_base 7: mod_base = OTHER; note = 2'-deoxy-2'-fluoroguanosine-3'-phosphate
  modified_base 8: mod_base = OTHER; note = 2'-O-methyluridine-3'-phosphate
  modified_base 9: mod_base = OTHER; note = 2'-deoxy-2'-fluorouridine-3'-phosphate
  modified_base 10: mod_base = OTHER; note = 2'-deoxy-2'-fluorocytidine-3'-phosphate
  modified_base 11: mod_base = OTHER; note = 2'-deoxy-2'-fluorouridine-3'-phosphate
  modified_base 12: mod_base = OTHER; note = 2'-O-methyluridine-3'-phosphate
  modified_base 13: mod_base = OTHER; note = Guanosine-glycol nucleic acid (GNA), S-isomer
  modified_base 14: mod_base = OTHER; note = 2'-O-methylcytidine-3'-phosphate
  modified_base 15: mod_base = OTHER; note = 2'-deoxy-2'-fluorouridine-3'-phosphate
  modified_base 16: mod_base = OTHER; note = 2'-O-methylcytidine-3'-phosphate
  modified_base 17: mod_base = OTHER; note = 2'-deoxy-2'-fluorouridine-3'-phosphate
  modified_base 18: mod_base = OTHER; note = 2'-O-methyladenosine-3'-phosphate
  modified_base 19: mod_base = OTHER; note = 2'-deoxy-2'-fluorouridine-3'-phosphate
  modified_base 20: mod_base = OTHER; note = 2'-O-methyladenosine-3'-phosphate
  modified_base 21: mod_base = OTHER; note = 2'-deoxy-2'-fluoroadenosine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
aacagtgttcttgctctataa

SEQ ID NO: 377 - RNA, 21 nt, synthetic construct
  source 1..21: mol_type = other RNA
  modified_base 1: mod_base = OTHER; note = 2'-deoxy-2'-fluoroadenosine-3'-phosphorothioate
  modified_base 2: mod_base = OTHER; note = 2'-O-methyladenosine-3'-phosphorothioate
  modified_base 3: mod_base = OTHER; note = 2'-deoxy-2'-fluorocytidine-3'-phosphate
  modified_base 4: mod_base = OTHER; note = 2'-O-methyladenosine-3'-phosphate
  modified_base 5: mod_base = OTHER; note = 2'-deoxy-2'-fluoroguanosine-3'-phosphate
  modified_base 6: mod_base = OTHER; note = 2'-O-methyluridine-3'-phosphate
  modified_base 7: mod_base = OTHER; note = 2'-deoxy-2'-fluoroguanosine-3'-phosphate
  modified_base 8: mod_base = OTHER; note = 2'-O-methyluridine-3'-phosphate
  modified_base 9: mod_base = OTHER; note = 2'-deoxy-2'-fluorouridine-3'-phosphate
  modified_base 10: mod_base = OTHER; note = 2'-deoxy-2'-fluorocytidine-3'-phosphate
  modified_base 11: mod_base = OTHER; note = 2'-deoxy-2'-fluorouridine-3'-phosphate
  modified_base 12: mod_base = OTHER; note = Thymidine-glycol nucleic acid (GNA), S-Isomer
  modified_base 13: mod_base = OTHER; note = 2'-deoxy-2'-fluoroguanosine-3'-phosphate
  modified_base 14: mod_base = OTHER; note = 2'-O-methylcytidine-3'-phosphate
  modified_base 15: mod_base = OTHER; note = 2'-deoxy-2'-fluorouridine-3'-phosphate
  modified_base 16: mod_base = OTHER; note = 2'-O-methylcytidine-3'-phosphate
  modified_base 17: mod_base = OTHER; note = 2'-deoxy-2'-fluorouridine-3'-phosphate
  modified_base 18: mod_base = OTHER; note = 2'-O-methyladenosine-3'-phosphate
  modified_base 19: mod_base = OTHER; note = 2'-deoxy-2'-fluorouridine-3'-phosphate
  modified_base 20: mod_base = OTHER; note = 2'-O-methyladenosine-3'-phosphate
  modified_base 21: mod_base = OTHER; note = 2'-deoxy-2'-fluoroadenosine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
aacagtgttcttgctctataa

SEQ ID NO: 378 - RNA, 21 nt, synthetic construct
  source 1..21: mol_type = other RNA
  modified_base 1: mod_base = OTHER; note = 2'-deoxy-2'-fluoroadenosine-3'-phosphorothioate
  modified_base 2: mod_base = OTHER; note = 2'-O-methyladenosine-3'-phosphorothioate
  modified_base 3: mod_base = OTHER; note = 2'-deoxy-2'-fluorocytidine-3'-phosphate
  modified_base 4: mod_base = OTHER; note = 2'-O-methyladenosine-3'-phosphate
  modified_base 5: mod_base = OTHER; note = 2'-deoxy-2'-fluoroguanosine-3'-phosphate
  modified_base 6: mod_base = OTHER; note = 2'-O-methyluridine-3'-phosphate
  modified_base 7: mod_base = OTHER; note = 2'-deoxy-2'-fluoroguanosine-3'-phosphate
  modified_base 8: mod_base = OTHER; note = 2'-O-methyluridine-3'-phosphate
  modified_base 9: mod_base = OTHER; note = 2'-deoxy-2'-fluorouridine-3'-phosphate
  modified_base 10: mod_base = OTHER; note = 2'-deoxy-2'-fluorocytidine-3'-phosphate
  modified_base 11: mod_base = OTHER; note = Thymidine-glycol nucleic acid (GNA), S-Isomer
  modified_base 12: mod_base = OTHER; note = 2'-O-methyluridine-3'-phosphate
  modified_base 13: mod_base = OTHER; note = 2'-deoxy-2'-fluoroguanosine-3'-phosphate
  modified_base 14: mod_base = OTHER; note = 2'-O-methylcytidine-3'-phosphate
  modified_base 15: mod_base = OTHER; note = 2'-deoxy-2'-fluorouridine-3'-phosphate
  modified_base 16: mod_base = OTHER; note = 2'-O-methylcytidine-3'-phosphate
  modified_base 17: mod_base = OTHER; note = 2'-deoxy-2'-fluorouridine-3'-phosphate
  modified_base 18: mod_base = OTHER; note = 2'-O-methyladenosine-3'-phosphate
  modified_base 19: mod_base = OTHER; note = 2'-deoxy-2'-fluorouridine-3'-phosphate
  modified_base 20: mod_base = OTHER; note = 2'-O-methyladenosine-3'-phosphate
  modified_base 21: mod_base = OTHER; note = 2'-deoxy-2'-fluoroadenosine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
aacagtgttcttgctctataa

SEQ ID NO: 379 - RNA, 21 nt, synthetic construct
  source 1..21: mol_type = other RNA
  modified_base 1: mod_base = OTHER; note = 2'-deoxy-2'-fluoroadenosine-3'-phosphorothioate
  modified_base 2: mod_base = OTHER; note = 2'-O-methyladenosine-3'-phosphorothioate
  modified_base 3: mod_base = OTHER; note = 2'-deoxy-2'-fluorocytidine-3'-phosphate
  modified_base 4: mod_base = OTHER; note = 2'-O-methyladenosine-3'-phosphate
  modified_base 5: mod_base = OTHER; note = 2'-deoxy-2'-fluoroguanosine-3'-phosphate
  modified_base 6: mod_base = OTHER; note = 2'-O-methyluridine-3'-phosphate
  modified_base 7: mod_base = OTHER; note = 2'-deoxy-2'-fluoroguanosine-3'-phosphate
  modified_base 8: mod_base = OTHER; note = 2'-O-methyluridine-3'-phosphate
  modified_base 9: mod_base = OTHER; note = 2'-deoxy-2'-fluorouridine-3'-phosphate
  modified_base 10: mod_base = OTHER; note = Cytidine-glycol nucleic acid (GNA), S-isomer
  modified_base 11: mod_base = OTHER; note = 2'-deoxy-2'-fluorouridine-3'-phosphate
  modified_base 12: mod_base = OTHER; note = 2'-O-methyluridine-3'-phosphate
  modified_base 13: mod_base = OTHER; note = 2'-deoxy-2'-fluoroguanosine-3'-phosphate
  modified_base 14: mod_base = OTHER; note = 2'-O-methylcytidine-3'-phosphate
  modified_base 15: mod_base = OTHER; note = 2'-deoxy-2'-fluorouridine-3'-phosphate
  modified_base 16: mod_base = OTHER; note = 2'-O-methylcytidine-3'-phosphate
  modified_base 17: mod_base = OTHER; note = 2'-deoxy-2'-fluorouridine-3'-phosphate
  modified_base 18: mod_base = OTHER; note = 2'-O-methyladenosine-3'-phosphate
  modified_base 19: mod_base = OTHER; note = 2'-deoxy-2'-fluorouridine-3'-phosphate
  modified_base 20: mod_base = OTHER; note = 2'-O-methyladenosine-3'-phosphate
  modified_base 21: mod_base = OTHER; note = 2'-deoxy-2'-fluoroadenosine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
aacagtgttcttgctctataa

SEQ ID NO: 380 - RNA, 21 nt, synthetic construct
  source 1..21: mol_type = other RNA
  modified_base 1: mod_base = OTHER; note = 2'-deoxy-2'-fluoroadenosine-3'-phosphorothioate
  modified_base 2: mod_base = OTHER; note = 2'-O-methyladenosine-3'-phosphorothioate
  modified_base 3: mod_base = OTHER; note = 2'-deoxy-2'-fluorocytidine-3'-phosphate
  modified_base 4: mod_base = OTHER; note = 2'-O-methyladenosine-3'-phosphate
  modified_base 5: mod_base = OTHER; note = 2'-deoxy-2'-fluoroguanosine-3'-phosphate
  modified_base 6: mod_base = OTHER; note = 2'-O-methyluridine-3'-phosphate
  modified_base 7: mod_base = OTHER; note = 2'-deoxy-2'-fluoroguanosine-3'-phosphate
  modified_base 8: mod_base = OTHER; note = 2'-O-methyluridine-3'-phosphate
  modified_base 9: mod_base = OTHER; note = Thymidine-glycol nucleic acid (GNA), S-Isomer
  modified_base 10: mod_base = OTHER; note = 2'-deoxy-2'-fluorocytidine-3'-phosphate
  modified_base 11: mod_base = OTHER; note = 2'-deoxy-2'-fluorouridine-3'-phosphate
  modified_base 12: mod_base = OTHER; note = 2'-O-methyluridine-3'-phosphate
  modified_base 13: mod_base = OTHER; note = 2'-deoxy-2'-fluoroguanosine-3'-phosphate
  modified_base 14: mod_base = OTHER; note = 2'-O-methylcytidine-3'-phosphate
  modified_base 15: mod_base = OTHER; note = 2'-deoxy-2'-fluorouridine-3'-phosphate
  modified_base 16: mod_base = OTHER; note = 2'-O-methylcytidine-3'-phosphate
  modified_base 17: mod_base = OTHER; note = 2'-deoxy-2'-fluorouridine-3'-phosphate
  modified_base 18: mod_base = OTHER; note = 2'-O-methyladenosine-3'-phosphate
  modified_base 19: mod_base = OTHER; note = 2'-deoxy-2'-fluorouridine-3'-phosphate
  modified_base 20: mod_base = OTHER; note = 2'-O-methyladenosine-3'-phosphate
  modified_base 21: mod_base = OTHER; note = 2'-deoxy-2'-fluoroadenosine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
aacagtgttcttgctctataa

SEQ ID NO: 381 - RNA, 21 nt, synthetic construct
  source 1..21: mol_type = other RNA
  modified_base 1: mod_base = OTHER; note = 2'-deoxy-2'-fluoroadenosine-3'-phosphorothioate
  modified_base 2: mod_base = OTHER; note = 2'-O-methyladenosine-3'-phosphorothioate
  modified_base 3: mod_base = OTHER; note = 2'-deoxy-2'-fluorocytidine-3'-phosphate
  modified_base 4: mod_base = OTHER; note = 2'-O-methyladenosine-3'-phosphate
  modified_base 5: mod_base = OTHER; note = 2'-deoxy-2'-fluoroguanosine-3'-phosphate
  modified_base 6: mod_base = OTHER; note = 2'-O-methyluridine-3'-phosphate
  modified_base 7: mod_base = OTHER; note = 2'-deoxy-2'-fluoroguanosine-3'-phosphate
  modified_base 8: mod_base = OTHER; note = Thymidine-glycol nucleic acid (GNA), S-Isomer
  modified_base 9: mod_base = OTHER; note = 2'-deoxy-2'-fluorouridine-3'-phosphate
  modified_base 10: mod_base = OTHER; note = 2'-deoxy-2'-fluorocytidine-3'-phosphate
  modified_base 11: mod_base = OTHER; note = 2'-deoxy-2'-fluorouridine-3'-phosphate
  modified_base 12: mod_base = OTHER; note = 2'-O-methyluridine-3'-phosphate
  modified_base 13: mod_base = OTHER; note = 2'-deoxy-2'-fluoroguanosine-3'-phosphate
  modified_base 14: mod_base = OTHER; note = 2'-O-methylcytidine-3'-phosphate
  modified_base 15: mod_base = OTHER; note = 2'-deoxy-2'-fluorouridine-3'-phosphate
  modified_base 16: mod_base = OTHER; note = 2'-O-methylcytidine-3'-phosphate
  modified_base 17: mod_base = OTHER; note = 2'-deoxy-2'-fluorouridine-3'-phosphate
  modified_base 18: mod_base = OTHER; note = 2'-O-methyladenosine-3'-phosphate
  modified_base 19: mod_base = OTHER; note = 2'-deoxy-2'-fluorouridine-3'-phosphate
  modified_base 20: mod_base = OTHER; note = 2'-O-methyladenosine-3'-phosphate
  modified_base 21: mod_base = OTHER; note = 2'-deoxy-2'-fluoroadenosine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
aacagtgttcttgctctataa

SEQ ID NO: 382 - RNA, 21 nt, synthetic construct
  source 1..21: mol_type = other RNA
  modified_base 1: mod_base = OTHER; note = 2'-deoxy-2'-fluoroadenosine-3'-phosphorothioate
  modified_base 2: mod_base = OTHER; note = 2'-O-methyladenosine-3'-phosphorothioate
  modified_base 3: mod_base = OTHER; note = 2'-deoxy-2'-fluorocytidine-3'-phosphate
  modified_base 4: mod_base = OTHER; note = 2'-O-methyladenosine-3'-phosphate
  modified_base 5: mod_base = OTHER; note = 2'-deoxy-2'-fluoroguanosine-3'-phosphate
  modified_base 6: mod_base = OTHER; note = 2'-O-methyluridine-3'-phosphate
  modified_base 7: mod_base = OTHER; note = Guanosine-glycol nucleic acid (GNA), S-isomer
  modified_base 8: mod_base = OTHER; note = 2'-O-methyluridine-3'-phosphate
  modified_base 9: mod_base = OTHER; note = 2'-deoxy-2'-fluorouridine-3'-phosphate
  modified_base 10: mod_base = OTHER; note = 2'-deoxy-2'-fluorocytidine-3'-phosphate
  modified_base 11: mod_base = OTHER; note = 2'-deoxy-2'-fluorouridine-3'-phosphate
  modified_base 12: mod_base = OTHER; note = 2'-O-methyluridine-3'-phosphate
  modified_base 13: mod_base = OTHER; note = 2'-deoxy-2'-fluoroguanosine-3'-phosphate
  modified_base 14: mod_base = OTHER; note = 2'-O-methylcytidine-3'-phosphate
  modified_base 15: mod_base = OTHER; note = 2'-deoxy-2'-fluorouridine-3'-phosphate
  modified_base 16: mod_base = OTHER; note = 2'-O-methylcytidine-3'-phosphate
  modified_base 17: mod_base = OTHER; note = 2'-deoxy-2'-fluorouridine-3'-phosphate
  modified_base 18: mod_base = OTHER; note = 2'-O-methyladenosine-3'-phosphate
  modified_base 19: mod_base = OTHER; note = 2'-deoxy-2'-fluorouridine-3'-phosphate
  modified_base 20: mod_base = OTHER; note = 2'-O-methyladenosine-3'-phosphate
  modified_base 21: mod_base = OTHER; note = 2'-deoxy-2'-fluoroadenosine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
aacagtgttcttgctctataa

SEQ ID NO: 383 - RNA, 21 nt, synthetic construct
  source 1..21: mol_type = other RNA
  modified_base 1: mod_base = OTHER; note = 2'-deoxy-2'-fluoroadenosine-3'-phosphorothioate
  modified_base 2: mod_base = OTHER; note = 2'-O-methyladenosine-3'-phosphorothioate
  modified_base 3: mod_base = OTHER; note = 2'-deoxy-2'-fluorocytidine-3'-phosphate
  modified_base 4: mod_base = OTHER; note = 2'-O-methyladenosine-3'-phosphate
  modified_base 5: mod_base = OTHER; note = 2'-deoxy-2'-fluoroguanosine-3'-phosphate
  modified_base 6: mod_base = OTHER; note = Thymidine-glycol nucleic acid (GNA), S-Isomer
  modified_base 7: mod_base = OTHER; note = 2'-deoxy-2'-fluoroguanosine-3'-phosphate
  modified_base 8: mod_base = OTHER; note = 2'-O-methyluridine-3'-phosphate
  modified_base 9: mod_base = OTHER; note = 2'-deoxy-2'-fluorouridine-3'-phosphate
  modified_base 10: mod_base = OTHER; note = 2'-deoxy-2'-fluorocytidine-3'-phosphate
  modified_base 11: mod_base = OTHER; note = 2'-deoxy-2'-fluorouridine-3'-phosphate
  modified_base 12: mod_base = OTHER; note = 2'-O-methyluridine-3'-phosphate
  modified_base 13: mod_base = OTHER; note = 2'-deoxy-2'-fluoroguanosine-3'-phosphate
  modified_base 14: mod_base = OTHER; note = 2'-O-methylcytidine-3'-phosphate
  modified_base 15: mod_base = OTHER; note = 2'-deoxy-2'-fluorouridine-3'-phosphate
  modified_base 16: mod_base = OTHER; note = 2'-O-methylcytidine-3'-phosphate
  modified_base 17: mod_base = OTHER; note = 2'-deoxy-2'-fluorouridine-3'-phosphate
  modified_base 18: mod_base = OTHER; note = 2'-O-methyladenosine-3'-phosphate
  modified_base 19: mod_base = OTHER; note = 2'-deoxy-2'-fluorouridine-3'-phosphate
  modified_base 20: mod_base = OTHER; note = 2'-O-methyladenosine-3'-phosphate
  modified_base 21: mod_base = OTHER; note = 2'-deoxy-2'-fluoroadenosine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
aacagtgttcttgctctataa

SEQ ID NO: 384 - RNA, 21 nt, synthetic construct
  source 1..21: mol_type = other RNA
  modified_base 1: mod_base = OTHER; note = 2'-deoxy-2'-fluoroadenosine-3'-phosphorothioate
  modified_base 2: mod_base = OTHER; note = 2'-O-methyladenosine-3'-phosphorothioate
  modified_base 3: mod_base = OTHER; note = 2'-deoxy-2'-fluorocytidine-3'-phosphate
  modified_base 4: mod_base = OTHER; note = 2'-O-methyladenosine-3'-phosphate
  modified_base 5: mod_base = OTHER; note = Guanosine-glycol nucleic acid (GNA), S-isomer
  modified_base 6: mod_base = OTHER; note = 2'-O-methyluridine-3'-phosphate
  modified_base 7: mod_base = OTHER; note = 2'-deoxy-2'-fluoroguanosine-3'-phosphate
  modified_base 8: mod_base = OTHER; note = 2'-O-methyluridine-3'-phosphate
  modified_base 9: mod_base = OTHER; note = 2'-deoxy-2'-fluorouridine-3'-phosphate
  modified_base 10: mod_base = OTHER; note = 2'-deoxy-2'-fluorocytidine-3'-phosphate
  modified_base 11: mod_base = OTHER; note = 2'-deoxy-2'-fluorouridine-3'-phosphate
  modified_base 12: mod_base = OTHER; note = 2'-O-methyluridine-3'-phosphate
  modified_base 13: mod_base = OTHER; note = 2'-deoxy-2'-fluoroguanosine-3'-phosphate
  modified_base 14: mod_base = OTHER; note = 2'-O-methylcytidine-3'-phosphate
  modified_base 15: mod_base = OTHER; note = 2'-deoxy-2'-fluorouridine-3'-phosphate
  modified_base 16: mod_base = OTHER; note = 2'-O-methylcytidine-3'-phosphate
  modified_base 17: mod_base = OTHER; note = 2'-deoxy-2'-fluorouridine-3'-phosphate
  modified_base 18: mod_base = OTHER; note = 2'-O-methyladenosine-3'-phosphate
  modified_base 19: mod_base = OTHER; note = 2'-deoxy-2'-fluorouridine-3'-phosphate
  modified_base 20: mod_base = OTHER; note = 2'-O-methyladenosine-3'-phosphate
  modified_base 21: mod_base = OTHER; note = 2'-deoxy-2'-fluoroadenosine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
aacagtgttcttgctctataa

SEQ ID NO: 385 - RNA, 21 nt, synthetic construct
  source 1..21: mol_type = other RNA
  modified_base 1: mod_base = OTHER; note = 2'-deoxy-2'-fluoroadenosine-3'-phosphorothioate
  modified_base 2: mod_base = OTHER; note = 2'-O-methyladenosine-3'-phosphorothioate
  modified_base 3: mod_base = OTHER; note = 2'-deoxy-2'-fluorocytidine-3'-phosphate
  modified_base 4: mod_base = OTHER; note = Adenosine-glycol nucleic acid (GNA), S-isomer
  modified_base 5: mod_base = OTHER; note = 2'-deoxy-2'-fluoroguanosine-3'-phosphate
  modified_base 6: mod_base = OTHER; note = 2'-O-methyluridine-3'-phosphate
  modified_base 7: mod_base = OTHER; note = 2'-deoxy-2'-fluoroguanosine-3'-phosphate
  modified_base 8: mod_base = OTHER; note = 2'-O-methyluridine-3'-phosphate
  modified_base 9: mod_base = OTHER; note = 2'-deoxy-2'-fluorouridine-3'-phosphate
  modified_base 10: mod_base = OTHER; note = 2'-deoxy-2'-fluorocytidine-3'-phosphate
  modified_base 11: mod_base = OTHER; note = 2'-deoxy-2'-fluorouridine-3'-phosphate
  modified_base 12: mod_base = OTHER; note = 2'-O-methyluridine-3'-phosphate
  modified_base 13: mod_base = OTHER; note = 2'-deoxy-2'-fluoroguanosine-3'-phosphate
  modified_base 14: mod_base = OTHER; note = 2'-O-methylcytidine-3'-phosphate
  modified_base 15: mod_base = OTHER; note = 2'-deoxy-2'-fluorouridine-3'-phosphate
  modified_base 16: mod_base = OTHER; note = 2'-O-methylcytidine-3'-phosphate
  modified_base 17: mod_base = OTHER; note = 2'-deoxy-2'-fluorouridine-3'-phosphate
  modified_base 18: mod_base = OTHER; note = 2'-O-methyladenosine-3'-phosphate
  modified_base 19: mod_base = OTHER; note = 2'-deoxy-2'-fluorouridine-3'-phosphate
  modified_base 20: mod_base = OTHER; note = 2'-O-methyladenosine-3'-phosphate
  modified_base 21: mod_base = OTHER; note = 2'-deoxy-2'-fluoroadenosine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
aacagtgttcttgctctataa

SEQ ID NO: 386 - RNA, 21 nt, synthetic construct
  source 1..21: mol_type = other RNA
  modified_base 1: mod_base = OTHER; note = 2'-deoxy-2'-fluoroadenosine-3'-phosphorothioate
  modified_base 2: mod_base = OTHER; note = 2'-O-methyladenosine-3'-phosphorothioate
  modified_base 3: mod_base = OTHER; note = Cytidine-glycol nucleic acid (GNA), S-isomer
  modified_base 4: mod_base = OTHER; note = 2'-O-methyladenosine-3'-phosphate
  modified_base 5: mod_base = OTHER; note = 2'-deoxy-2'-fluoroguanosine-3'-phosphate
  modified_base 6: mod_base = OTHER; note = 2'-O-methyluridine-3'-phosphate
  modified_base 7: mod_base = OTHER; note = 2'-deoxy-2'-fluoroguanosine-3'-phosphate
  modified_base 8: mod_base = OTHER; note = 2'-O-methyluridine-3'-phosphate
  modified_base 9: mod_base = OTHER; note = 2'-deoxy-2'-fluorouridine-3'-phosphate
  modified_base 10: mod_base = OTHER; note = 2'-deoxy-2'-fluorocytidine-3'-phosphate
  modified_base 11: mod_base = OTHER; note = 2'-deoxy-2'-fluorouridine-3'-phosphate
  modified_base 12: mod_base = OTHER; note = 2'-O-methyluridine-3'-phosphate
  modified_base 13: mod_base = OTHER; note = 2'-deoxy-2'-fluoroguanosine-3'-phosphate
  modified_base 14: mod_base = OTHER; note = 2'-O-methylcytidine-3'-phosphate
  modified_base 15: mod_base = OTHER; note = 2'-deoxy-2'-fluorouridine-3'-phosphate
  modified_base 16: mod_base = OTHER; note = 2'-O-methylcytidine-3'-phosphate
  modified_base 17: mod_base = OTHER; note = 2'-deoxy-2'-fluorouridine-3'-phosphate
  modified_base 18: mod_base = OTHER; note = 2'-O-methyladenosine-3'-phosphate
  modified_base 19: mod_base = OTHER; note = 2'-deoxy-2'-fluorouridine-3'-phosphate
  modified_base 20: mod_base = OTHER; note = 2'-O-methyladenosine-3'-phosphate
  modified_base 21: mod_base = OTHER; note = 2'-deoxy-2'-fluoroadenosine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
aacagtgttcttgctctataa

SEQ ID NO: 387 - RNA, 21 nt, synthetic construct
  source 1..21: mol_type = other RNA
  modified_base 1: mod_base = OTHER; note = 2'-deoxy-2'-fluoroadenosine-3'-phosphorothioate
  modified_base 2: mod_base = OTHER; note = Adenosine-glycol nucleic acid (GNA), S-isomer phosphorothioate
  modified_base 3: mod_base = OTHER; note = 2'-deoxy-2'-fluorocytidine-3'-phosphate
  modified_base 4: mod_base = OTHER; note = 2'-O-methyladenosine-3'-phosphate
  modified_base 5: mod_base = OTHER; note = 2'-deoxy-2'-fluoroguanosine-3'-phosphate
  modified_base 6: mod_base = OTHER; note = 2'-O-methyluridine-3'-phosphate
  modified_base 7: mod_base = OTHER; note = 2'-deoxy-2'-fluoroguanosine-3'-phosphate
  modified_base 8: mod_base = OTHER; note = 2'-O-methyluridine-3'-phosphate
  modified_base 9: mod_base = OTHER; note = 2'-deoxy-2'-fluorouridine-3'-phosphate
  modified_base 10: mod_base = OTHER; note = 2'-deoxy-2'-fluorocytidine-3'-phosphate
  modified_base 11: mod_base = OTHER; note = 2'-deoxy-2'-fluorouridine-3'-phosphate
  modified_base 12: mod_base = OTHER; note = 2'-O-methyluridine-3'-phosphate
  modified_base 13: mod_base = OTHER; note = 2'-deoxy-2'-fluoroguanosine-3'-phosphate
  modified_base 14: mod_base = OTHER; note = 2'-O-methylcytidine-3'-phosphate
  modified_base 15: mod_base = OTHER; note = 2'-deoxy-2'-fluorouridine-3'-phosphate
  modified_base 16: mod_base = OTHER; note = 2'-O-methylcytidine-3'-phosphate
  modified_base 17: mod_base = OTHER; note = 2'-deoxy-2'-fluorouridine-3'-phosphate
  modified_base 18: mod_base = OTHER; note = 2'-O-methyladenosine-3'-phosphate
  modified_base 19: mod_base = OTHER; note = 2'-deoxy-2'-fluorouridine-3'-phosphate
  modified_base 20: mod_base = OTHER; note = 2'-O-methyladenosine-3'-phosphate
  modified_base 21: mod_base = OTHER; note = 2'-deoxy-2'-fluoroadenosine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
aacagtgttcttgctctataa

SEQ ID NO: 388 - RNA, 21 nt, synthetic construct
  source 1..21: mol_type = other RNA
  modified_base 1: mod_base = OTHER; note = Adenosine-glycol nucleic acid (GNA), S-isomer phosphorothioate
  modified_base 2: mod_base = OTHER; note = 2'-O-methyladenosine-3'-phosphorothioate
  modified_base 3: mod_base = OTHER; note = 2'-deoxy-2'-fluorocytidine-3'-phosphate
  modified_base 4: mod_base = OTHER; note = 2'-O-methyladenosine-3'-phosphate
  modified_base 5: mod_base = OTHER; note = 2'-deoxy-2'-fluoroguanosine-3'-phosphate
  modified_base 6: mod_base = OTHER; note = 2'-O-methyluridine-3'-phosphate
  modified_base 7: mod_base = OTHER; note = 2'-deoxy-2'-fluoroguanosine-3'-phosphate
  modified_base 8: mod_base = OTHER; note = 2'-O-methyluridine-3'-phosphate
  modified_base 9: mod_base = OTHER; note = 2'-deoxy-2'-fluorouridine-3'-phosphate
  modified_base 10: mod_base = OTHER; note = 2'-deoxy-2'-fluorocytidine-3'-phosphate
  modified_base 11: mod_base = OTHER; note = 2'-deoxy-2'-fluorouridine-3'-phosphate
  modified_base 12: mod_base = OTHER; note = 2'-O-methyluridine-3'-phosphate
  modified_base 13: mod_base = OTHER; note = 2'-deoxy-2'-fluoroguanosine-3'-phosphate
  modified_base 14: mod_base = OTHER; note = 2'-O-methylcytidine-3'-phosphate
  modified_base 15: mod_base = OTHER; note = 2'-deoxy-2'-fluorouridine-3'-phosphate
  modified_base 16: mod_base = OTHER; note = 2'-O-methylcytidine-3'-phosphate
  modified_base 17: mod_base = OTHER; note = 2'-deoxy-2'-fluorouridine-3'-phosphate
  modified_base 18: mod_base = OTHER; note = 2'-O-methyladenosine-3'-phosphate
  modified_base 19: mod_base = OTHER; note = 2'-deoxy-2'-fluorouridine-3'-phosphate
  modified_base 20: mod_base = OTHER; note = 2'-O-methyladenosine-3'-phosphate
  modified_base 21: mod_base = OTHER; note = 2'-deoxy-2'-fluoroadenosine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
aacagtgttcttgctctataa

SEQ ID NO: 389 - RNA, 21 nt, synthetic construct
  source 1..21: mol_type = other RNA
  modified_base 1: mod_base = OTHER; note = 2'-deoxy-2'-fluoroadenosine-3'-phosphorothioate
  modified_base 2: mod_base = OTHER; note = 2'-O-methyladenosine-3'-phosphorothioate
  modified_base 3: mod_base = OTHER; note = 2'-deoxy-2'-fluorocytidine-3'-phosphate
  modified_base 4: mod_base = OTHER; note = 2'-O-methyladenosine-3'-phosphate
  modified_base 5: mod_base = OTHER; note = 2'-deoxy-2'-fluoroguanosine-3'-phosphate
  modified_base 6: mod_base = OTHER; note = 2'-O-methyluridine-3'-phosphate
  modified_base 7: mod_base = OTHER; note = 2'-deoxy-2'-fluoroguanosine-3'-phosphate
  modified_base 8: mod_base = OTHER; note = 2'-O-methyluridine-3'-phosphate
  modified_base 9: mod_base = OTHER; note = 2'-deoxy-2'-fluorouridine-3'-phosphate
  modified_base 10: mod_base = OTHER; note = 2'-deoxy-2'-fluorocytidine-3'-phosphate
  modified_base 11: mod_base = OTHER; note = 2'-deoxy-2'-fluorouridine-3'-phosphate
  modified_base 12: mod_base = OTHER; note = 2'-O-methyluridine-3'-phosphate
  modified_base 13: mod_base = OTHER; note = 2'-deoxy-2'-fluoroguanosine-3'-phosphate
  modified_base 14: mod_base = OTHER; note = 2'-O-methylcytidine-3'-phosphate
  modified_base 15: mod_base = OTHER; note = Thymidine-glycol nucleic acid (GNA), S-Isomer
  modified_base 16: mod_base = OTHER; note = 2'-O-methylcytidine-3'-phosphate
  modified_base 17: mod_base = OTHER; note = 2'-deoxy-2'-fluorouridine-3'-phosphate
  modified_base 18: mod_base = OTHER; note = 2'-O-methyladenosine-3'-phosphate
  modified_base 19: mod_base = OTHER; note = 2'-deoxy-2'-fluorouridine-3'-phosphate
  modified_base 20: mod_base = OTHER; note = 2'-O-methyladenosine-3'-phosphate
  modified_base 21: mod_base = OTHER; note = 2'-deoxy-2'-fluoroadenosine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
aacagtgttcttgctctataa

SEQ ID NO: 390 - RNA, 21 nt, synthetic construct
  source 1..21: mol_type = other RNA
  modified_base 1: mod_base = OTHER; note = 2'-deoxy-2'-fluoroadenosine-3'-phosphorothioate
  modified_base 2: mod_base = OTHER; note = 2'-O-methyladenosine-3'-phosphorothioate
  modified_base 3: mod_base = OTHER; note = 2'-deoxy-2'-fluorocytidine-3'-phosphate
  modified_base 4: mod_base = OTHER; note = 2'-O-methyladenosine-3'-phosphate
  modified_base 5: mod_base = OTHER; note = 2'-deoxy-2'-fluoroguanosine-3'-phosphate
  modified_base 6: mod_base = OTHER; note = 2'-O-methyluridine-3'-phosphate
  modified_base 7: mod_base = OTHER; note = 2'-deoxy-2'-fluoroguanosine-3'-phosphate
  modified_base 8: mod_base = OTHER; note = 2'-O-methyluridine-3'-phosphate
  modified_base 9: mod_base = OTHER; note = 2'-deoxy-2'-fluorouridine-3'-phosphate
  modified_base 10: mod_base = OTHER; note = 2'-deoxy-2'-fluorocytidine-3'-phosphate
  modified_base 11: mod_base = OTHER; note = 2'-deoxy-2'-fluorouridine-3'-phosphate
  modified_base 12: mod_base = OTHER; note = 2'-O-methyluridine-3'-phosphate
  modified_base 13: mod_base = OTHER; note = 2'-deoxy-2'-fluoroguanosine-3'-phosphate
  modified_base 14: mod_base = OTHER; note = 2'-O-methylcytidine-3'-phosphate
  modified_base 15: mod_base = OTHER; note = 2'-deoxy-2'-fluorouridine-3'-phosphate
  modified_base 16: mod_base = OTHER; note = 2'-O-methylcytidine-3'-phosphate
  modified_base 17: mod_base = OTHER; note = Thymidine-glycol nucleic acid (GNA), S-Isomer
  modified_base 18: mod_base = OTHER; note = 2'-O-methyladenosine-3'-phosphate
  modified_base 19: mod_base = OTHER; note = 2'-deoxy-2'-fluorouridine-3'-phosphate
  modified_base 20: mod_base = OTHER; note = 2'-O-methyladenosine-3'-phosphate
  modified_base 21: mod_base = OTHER; note = 2'-deoxy-2'-fluoroadenosine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
aacagtgttcttgctctataa

SEQ ID NO: 391 - RNA, 21 nt, synthetic construct
  source 1..21: mol_type = other RNA
  modified_base 1: mod_base = OTHER; note = 2'-deoxy-2'-fluoroadenosine-3'-phosphorothioate
  modified_base 2: mod_base = OTHER; note = 2'-O-methyladenosine-3'-phosphorothioate
  modified_base 3: mod_base = OTHER; note = 2'-deoxy-2'-fluorocytidine-3'-phosphate
  modified_base 4: mod_base = OTHER; note = 2'-O-methyladenosine-3'-phosphate
  modified_base 5: mod_base = OTHER; note = 2'-deoxy-2'-fluoroguanosine-3'-phosphate
  modified_base 6: mod_base = OTHER; note = 2'-O-methyluridine-3'-phosphate
  modified_base 7: mod_base = OTHER; note = 2'-deoxy-2'-fluoroguanosine-3'-phosphate
  modified_base 8: mod_base = OTHER; note = 2'-O-methyluridine-3'-phosphate
  modified_base 9: mod_base = OTHER; note = 2'-deoxy-2'-fluorouridine-3'-phosphate
  modified_base 10: mod_base = OTHER; note = 2'-deoxy-2'-fluorocytidine-3'-phosphate
  modified_base 11: mod_base = OTHER; note = 2'-deoxy-2'-fluorouridine-3'-phosphate
  modified_base 12: mod_base = OTHER; note = 2'-O-methyluridine-3'-phosphate
  modified_base 13: mod_base = OTHER; note = 2'-deoxy-2'-fluoroguanosine-3'-phosphate
  modified_base 14: mod_base = OTHER; note = 2'-O-methylcytidine-3'-phosphate
  modified_base 15: mod_base = OTHER; note = 2'-deoxy-2'-fluorouridine-3'-phosphate
  modified_base 16: mod_base = OTHER; note = Cytidine-glycol nucleic acid (GNA), S-isomer
  modified_base 17: mod_base = OTHER; note = 2'-deoxy-2'-fluorouridine-3'-phosphate
  modified_base 18: mod_base = OTHER; note = 2'-O-methyladenosine-3'-phosphate
  modified_base 19: mod_base = OTHER; note = 2'-deoxy-2'-fluorouridine-3'-phosphate
  modified_base 20: mod_base = OTHER; note = 2'-O-methyladenosine-3'-phosphate
  modified_base 21: mod_base = OTHER; note = 2'-deoxy-2'-fluoroadenosine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
aacagtgttcttgctctataa

SEQ ID NO: 392 - RNA, 21 nt, synthetic construct
  source 1..21: mol_type = other RNA
  modified_base 1: mod_base = OTHER; note = 2'-deoxy-2'-fluoroadenosine-3'-phosphorothioate
  modified_base 2: mod_base = OTHER; note = 2'-O-methyladenosine-3'-phosphorothioate
  modified_base 3: mod_base = OTHER; note = 2'-deoxy-2'-fluorocytidine-3'-phosphate
  modified_base 4: mod_base = OTHER; note = 2'-O-methyladenosine-3'-phosphate
  modified_base 5: mod_base = OTHER; note = 2'-deoxy-2'-fluoroguanosine-3'-phosphate
  modified_base 6: mod_base = OTHER; note = 2'-O-methyluridine-3'-phosphate
  modified_base 7: mod_base = OTHER; note = 2'-deoxy-2'-fluoroguanosine-3'-phosphate
  modified_base 8: mod_base = OTHER; note = 2'-O-methyluridine-3'-phosphate
  modified_base 9: mod_base = OTHER; note = 2'-deoxy-2'-fluorouridine-3'-phosphate
  modified_base 10: mod_base = OTHER; note = 2'-deoxy-2'-fluorocytidine-3'-phosphate
  modified_base 11: mod_base = OTHER; note = 2'-deoxy-2'-fluorouridine-3'-phosphate
  modified_base 12: mod_base = OTHER; note = 2'-O-methyluridine-3'-phosphate
  modified_base 13: mod_base = OTHER; note = 2'-deoxy-2'-fluoroguanosine-3'-phosphate
  modified_base 14: mod_base = OTHER; note = 2'-O-methylcytidine-3'-phosphate
  modified_base 15: mod_base = OTHER; note = 2'-deoxy-2'-fluorouridine-3'-phosphate
  modified_base 16: mod_base = OTHER; note = 2'-O-methylcytidine-3'-phosphate
  modified_base 17: mod_base = OTHER; note = Thymidine-glycol nucleic acid (GNA), S-Isomer
  modified_base 18: mod_base = OTHER; note = 2'-O-methyladenosine-3'-phosphate
  modified_base 19: mod_base = OTHER; note = 2'-deoxy-2'-fluorouridine-3'-phosphate
  modified_base 20: mod_base = OTHER; note = 2'-O-methyladenosine-3'-phosphate
  modified_base 21: mod_base = OTHER; note = 2'-deoxy-2'-fluoroadenosine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
aacagtgttcttgctctataa

SEQ ID NO: 393 - RNA, 21 nt, synthetic construct
  source 1..21: mol_type = other RNA
  modified_base 1: mod_base = OTHER; note = 2'-deoxy-2'-fluoroadenosine-3'-phosphorothioate
  modified_base 2: mod_base = OTHER; note = 2'-O-methyladenosine-3'-phosphorothioate
  modified_base 3: mod_base = OTHER; note = 2'-deoxy-2'-fluorocytidine-3'-phosphate
  modified_base 4: mod_base = OTHER; note = 2'-O-methyladenosine-3'-phosphate
  modified_base 5: mod_base = OTHER; note = 2'-deoxy-2'-fluoroguanosine-3'-phosphate
  modified_base 6: mod_base = OTHER; note = 2'-O-methyluridine-3'-phosphate
  modified_base 7: mod_base = OTHER; note = 2'-deoxy-2'-fluoroguanosine-3'-phosphate
  modified_base 8: mod_base = OTHER; note = 2'-O-methyluridine-3'-phosphate
  modified_base 9: mod_base = OTHER; note = 2'-deoxy-2'-fluorouridine-3'-phosphate
  modified_base 10: mod_base = OTHER; note = 2'-deoxy-2'-fluorocytidine-3'-phosphate
  modified_base 11: mod_base = OTHER; note = 2'-deoxy-2'-fluorouridine-3'-phosphate
  modified_base 12: mod_base = OTHER; note = 2'-O-methyluridine-3'-phosphate
  modified_base 13: mod_base = OTHER; note = 2'-deoxy-2'-fluoroguanosine-3'-phosphate
  modified_base 14: mod_base = OTHER; note = 2'-O-methylcytidine-3'-phosphate
  modified_base 15: mod_base = OTHER; note = Thymidine-glycol nucleic acid (GNA), S-Isomer
  modified_base 16: mod_base = OTHER; note = 2'-O-methylcytidine-3'-phosphate
  modified_base 17: mod_base = OTHER; note = 2'-deoxy-2'-fluorouridine-3'-phosphate
  modified_base 18: mod_base = OTHER; note = 2'-O-methyladenosine-3'-phosphate
  modified_base 19: mod_base = OTHER; note = 2'-deoxy-2'-fluorouridine-3'-phosphate
  modified_base 20: mod_base = OTHER; note = 2'-O-methyladenosine-3'-phosphate
  modified_base 21: mod_base = OTHER; note = 2'-deoxy-2'-fluoroadenosine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
aacagtgttcttgctctataa

SEQ ID NO: 394 - RNA, 21 nt, synthetic construct
  source 1..21: mol_type = other RNA
  modified_base 1: mod_base = OTHER; note = 2'-deoxy-2'-fluoroadenosine-3'-phosphorothioate
  modified_base 2: mod_base = OTHER; note = 2'-O-methyladenosine-3'-phosphorothioate
  modified_base 3: mod_base = OTHER; note = 2'-deoxy-2'-fluorocytidine-3'-phosphate
  modified_base 4: mod_base = OTHER; note = 2'-O-methyladenosine-3'-phosphate
  modified_base 5: mod_base = OTHER; note = 2'-deoxy-2'-fluoroguanosine-3'-phosphate
  modified_base 6: mod_base = OTHER; note = 2'-O-methyluridine-3'-phosphate
  modified_base 7: mod_base = OTHER; note = 2'-deoxy-2'-fluoroguanosine-3'-phosphate
  modified_base 8: mod_base = OTHER; note = 2'-O-methyluridine-3'-phosphate
  modified_base 9: mod_base = OTHER; note = 2'-deoxy-2'-fluorouridine-3'-phosphate
  modified_base 10: mod_base = OTHER; note = 2'-deoxy-2'-fluorocytidine-3'-phosphate
  modified_base 11: mod_base = OTHER; note = 2'-deoxy-2'-fluorouridine-3'-phosphate
  modified_base 12: mod_base = OTHER; note = 2'-O-methyluridine-3'-phosphate
  modified_base 13: mod_base = OTHER; note = 2'-deoxy-2'-fluoroguanosine-3'-phosphate
  modified_base 14: mod_base = OTHER; note = 2'-O-methylcytidine-3'-phosphate
  modified_base 15: mod_base = OTHER; note = 2'-deoxy-2'-fluorouridine-3'-phosphate
  modified_base 16: mod_base = OTHER; note = Cytidine-glycol nucleic acid (GNA), S-isomer
  modified_base 17: mod_base = OTHER; note = 2'-deoxy-2'-fluorouridine-3'-phosphate
  modified_base 18: mod_base = OTHER; note = 2'-O-methyladenosine-3'-phosphate
  modified_base 19: mod_base = OTHER; note = 2'-deoxy-2'-fluorouridine-3'-phosphate
  modified_base 20: mod_base = OTHER; note = 2'-O-methyladenosine-3'-phosphate
  modified_base 21: mod_base = OTHER; note = 2'-deoxy-2'-fluoroadenosine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
aacagtgttcttgctctataa

SEQ ID NO: 395 - RNA, 21 nt, synthetic construct
  source 1..21: mol_type = other RNA
  modified_base 1: mod_base = OTHER; note = 2'-deoxy-2'-fluoroadenosine-3'-phosphorothioate
  modified_base 2: mod_base = OTHER; note = 2'-O-methyladenosine-3'-phosphorothioate
  modified_base 3: mod_base = OTHER; note = 2'-deoxy-2'-fluorocytidine-3'-phosphate
  modified_base 4: mod_base = OTHER; note = 2'-O-methyladenosine-3'-phosphate
  modified_base 5: mod_base = OTHER; note = 2'-deoxy-2'-fluoroguanosine-3'-phosphate
  modified_base 6: mod_base = OTHER; note = 2'-O-methyluridine-3'-phosphate
  modified_base 7: mod_base = OTHER; note = 2'-deoxy-2'-fluoroguanosine-3'-phosphate
  modified_base 8: mod_base = OTHER; note = 2'-O-methyluridine-3'-phosphate
  modified_base 9: mod_base = OTHER; note = 2'-deoxy-2'-fluorouridine-3'-phosphate
  modified_base 10: mod_base = OTHER; note = 2'-deoxy-2'-fluorocytidine-3'-phosphate
  modified_base 11: mod_base = OTHER; note = 2'-deoxy-2'-fluorouridine-3'-phosphate
  modified_base 12: mod_base = OTHER; note = 2'-O-methyluridine-3'-phosphate
  modified_base 13: mod_base = OTHER; note = 2'-deoxy-2'-fluoroguanosine-3'-phosphate
  modified_base 14: mod_base = OTHER; note = 2'-O-methylcytidine-3'-phosphate
  modified_base 15: mod_base = OTHER; note = 2'-deoxy-2'-fluorouridine-3'-phosphate
  modified_base 16: mod_base = OTHER; note = 2'-O-methylcytidine-3'-phosphate
  modified_base 17: mod_base = OTHER; note = Thymidine-glycol nucleic acid (GNA), S-Isomer
  modified_base 18: mod_base = OTHER; note = 2'-O-methyladenosine-3'-phosphate
  modified_base 19: mod_base = OTHER; note = 2'-deoxy-2'-fluorouridine-3'-phosphate
  modified_base 20: mod_base = OTHER; note = 2'-O-methyladenosine-3'-phosphate
  modified_base 21: mod_base = OTHER; note = 2'-deoxy-2'-fluoroadenosine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
aacagtgttcttgctctataa

SEQ ID NO: 396 - RNA, 21 nt, synthetic construct
  source 1..21: mol_type = other RNA
  modified_base 1: mod_base = OTHER; note = 2'-deoxy-2'-fluoroadenosine-3'-phosphorothioate
  modified_base 2: mod_base = OTHER; note = 2'-O-methyladenosine-3'-phosphorothioate
  modified_base 3: mod_base = OTHER; note = 2'-deoxy-2'-fluorocytidine-3'-phosphate
  modified_base 4: mod_base = OTHER; note = 2'-O-methyladenosine-3'-phosphate
  modified_base 5: mod_base = OTHER; note = 2'-deoxy-2'-fluoroguanosine-3'-phosphate
  modified_base 6: mod_base = OTHER; note = 2'-O-methyluridine-3'-phosphate
  modified_base 7: mod_base = OTHER; note = 2'-deoxy-2'-fluoroguanosine-3'-phosphate
  modified_base 8: mod_base = OTHER; note = 2'-O-methyluridine-3'-phosphate
  modified_base 9: mod_base = OTHER; note = 2'-deoxy-2'-fluorouridine-3'-phosphate
  modified_base 10: mod_base = OTHER; note = 2'-deoxy-2'-fluorocytidine-3'-phosphate
  modified_base 11: mod_base = OTHER; note = 2'-deoxy-2'-fluorouridine-3'-phosphate
  modified_base 12: mod_base = OTHER; note = 2'-O-methyluridine-3'-phosphate
  modified_base 13: mod_base = OTHER; note = 2'-deoxy-2'-fluoroguanosine-3'-phosphate
  modified_base 14: mod_base = OTHER; note = 2'-O-methylcytidine-3'-phosphate
  modified_base 15: mod_base = OTHER; note = Thymidine-glycol nucleic acid (GNA), S-Isomer
  modified_base 16: mod_base = OTHER; note = 2'-O-methylcytidine-3'-phosphate
  modified_base 17: mod_base = OTHER; note = 2'-deoxy-2'-fluorouridine-3'-phosphate
  modified_base 18: mod_base = OTHER; note = 2'-O-methyladenosine-3'-phosphate
  modified_base 19: mod_base = OTHER; note = 2'-deoxy-2'-fluorouridine-3'-phosphate
  modified_base 20: mod_base = OTHER; note = 2'-O-methyladenosine-3'-phosphate
  modified_base 21: mod_base = OTHER; note = 2'-deoxy-2'-fluoroadenosine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
aacagtgttcttgctctataa

SEQ ID NO: 397 - RNA, 21 nt, synthetic construct
  source 1..21: mol_type = other RNA
  modified_base 1: mod_base = OTHER; note = 2'-deoxy-2'-fluoroadenosine-3'-phosphorothioate
  modified_base 2: mod_base = OTHER; note = 2'-O-methyladenosine-3'-phosphorothioate
  modified_base 3: mod_base = OTHER; note = 2'-deoxy-2'-fluorocytidine-3'-phosphate
  modified_base 4: mod_base = OTHER; note = 2'-O-methyladenosine-3'-phosphate
  modified_base 5: mod_base = OTHER; note = 2'-deoxy-2'-fluoroguanosine-3'-phosphate
  modified_base 6: mod_base = OTHER; note = 2'-O-methyluridine-3'-phosphate
  modified_base 7: mod_base = OTHER; note = 2'-deoxy-2'-fluoroguanosine-3'-phosphate
  modified_base 8: mod_base = OTHER; note = 2'-O-methyluridine-3'-phosphate
  modified_base 9: mod_base = OTHER; note = 2'-deoxy-2'-fluorouridine-3'-phosphate
  modified_base 10: mod_base = OTHER; note = 2'-deoxy-2'-fluorocytidine-3'-phosphate
  modified_base 11: mod_base = OTHER; note = 2'-deoxy-2'-fluorouridine-3'-phosphate
  modified_base 12: mod_base = OTHER; note = 2'-O-methyluridine-3'-phosphate
  modified_base 13: mod_base = OTHER; note = 2'-deoxy-2'-fluoroguanosine-3'-phosphate
  modified_base 14: mod_base = OTHER; note = 2'-O-methylcytidine-3'-phosphate
  modified_base 15: mod_base = OTHER; note = 2'-deoxy-2'-fluorouridine-3'-phosphate
  modified_base 16: mod_base = OTHER; note = Cytidine-glycol nucleic acid (GNA), S-isomer
  modified_base 17: mod_base = OTHER; note = 2'-deoxy-2'-fluorouridine-3'-phosphate
  modified_base 18: mod_base = OTHER; note = 2'-O-methyladenosine-3'-phosphate
  modified_base 19: mod_base = OTHER; note = 2'-deoxy-2'-fluorouridine-3'-phosphate
  modified_base 20: mod_base = OTHER; note = 2'-O-methyladenosine-3'-phosphate
  modified_base 21: mod_base = OTHER; note = 2'-deoxy-2'-fluoroadenosine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
aacagtgttcttgctctataa

SEQ ID NO: 398 - RNA, 21 nt, synthetic construct
  source 1..21: mol_type = other RNA
  modified_base 1: mod_base = OTHER; note = 2'-deoxy-2'-fluoroadenosine-3'-phosphorothioate
  modified_base 2: mod_base = OTHER; note = 2'-O-methyladenosine-3'-phosphorothioate
  modified_base 3: mod_base = OTHER; note = 2'-deoxy-2'-fluorocytidine-3'-phosphate
  modified_base 4: mod_base = OTHER; note = 2'-O-methyladenosine-3'-phosphate
  modified_base 5: mod_base = OTHER; note = 2'-deoxy-2'-fluoroguanosine-3'-phosphate
  modified_base 6: mod_base = OTHER; note = 2'-O-methyluridine-3'-phosphate
  modified_base 7: mod_base = OTHER; note = 2'-deoxy-2'-fluoroguanosine-3'-phosphate
  modified_base 8: mod_base = OTHER; note = 2'-O-methyluridine-3'-phosphate
  modified_base 9: mod_base = OTHER; note = 2'-deoxy-2'-fluorouridine-3'-phosphate
  modified_base 10: mod_base = OTHER; note = 2'-deoxy-2'-fluorocytidine-3'-phosphate
  modified_base 11: mod_base = OTHER; note = 2'-deoxy-2'-fluorouridine-3'-phosphate
  modified_base 12: mod_base = OTHER; note = 2'-O-methyluridine-3'-phosphate
  modified_base 13: mod_base = OTHER; note = 2'-deoxy-2'-fluoroguanosine-3'-phosphate
  modified_base 14: mod_base = OTHER; note = 2'-O-methylcytidine-3'-phosphate
  modified_base 15: mod_base = OTHER; note = 2'-deoxy-2'-fluorouridine-3'-phosphate
  modified_base 16: mod_base = OTHER; note = 2'-O-methylcytidine-3'-phosphate
  modified_base 17: mod_base = OTHER; note = Thymidine-glycol nucleic acid (GNA), S-Isomer
  modified_base 18: mod_base = OTHER; note = 2'-O-methyladenosine-3'-phosphate
  modified_base 19: mod_base = OTHER; note = 2'-deoxy-2'-fluorouridine-3'-phosphate
  modified_base 20: mod_base = OTHER; note = 2'-O-methyladenosine-3'-phosphate
  modified_base 21: mod_base = OTHER; note = 2'-deoxy-2'-fluoroadenosine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
aacagtgttcttgctctataa

SEQ ID NO: 399 - RNA, 21 nt, synthetic construct
  source 1..21: mol_type = other RNA
  modified_base 1: mod_base = OTHER; note = 2'-deoxy-2'-fluoroadenosine-3'-phosphorothioate
  modified_base 2: mod_base = OTHER; note = Adenosine-glycol nucleic acid (GNA), S-isomer phosphorothioate
  modified_base 3: mod_base = OTHER; note = 2'-deoxy-2'-fluorocytidine-3'-phosphate
  modified_base 4: mod_base = OTHER; note = 2'-O-methyladenosine-3'-phosphate
  modified_base 5: mod_base = OTHER; note = 2'-deoxy-2'-fluoroguanosine-3'-phosphate
  modified_base 6: mod_base = OTHER; note = 2'-O-methyluridine-3'-phosphate
  modified_base 7: mod_base = OTHER; note = 2'-deoxy-2'-fluoroguanosine-3'-phosphate
  modified_base 8: mod_base = OTHER; note = 2'-O-methyluridine-3'-phosphate
  modified_base 9: mod_base = OTHER; note = 2'-deoxy-2'-fluorouridine-3'-phosphate
  modified_base 10: mod_base = OTHER; note = 2'-deoxy-2'-fluorocytidine-3'-phosphate
  modified_base 11: mod_base = OTHER; note = 2'-deoxy-2'-fluorouridine-3'-phosphate
  modified_base 12: mod_base = OTHER; note = 2'-O-methyluridine-3'-phosphate
  modified_base 13: mod_base = OTHER; note = 2'-deoxy-2'-fluoroguanosine-3'-phosphate
  modified_base 14: mod_base = OTHER; note = 2'-O-methylcytidine-3'-phosphate
  modified_base 15: mod_base = OTHER; note = 2'-deoxy-2'-fluorouridine-3'-phosphate
  modified_base 16: mod_base = OTHER; note = 2'-O-methylcytidine-3'-phosphate
  modified_base 17: mod_base = OTHER; note = 2'-deoxy-2'-fluorouridine-3'-phosphate
  modified_base 18: mod_base = OTHER; note = 2'-O-methyladenosine-3'-phosphate
  modified_base 19: mod_base = OTHER; note = 2'-deoxy-2'-fluorouridine-3'-phosphate
  modified_base 20: mod_base = OTHER; note = 2'-O-methyladenosine-3'-phosphate
  modified_base 21: mod_base = OTHER; note = 2'-deoxy-2'-fluoroadenosine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
aacagtgttcttgctctataa

SEQ ID NO: 400 - RNA, 21 nt, synthetic construct
  source 1..21: mol_type = other RNA
  modified_base 1: mod_base = OTHER; note = 2'-deoxy-2'-fluoroadenosine-3'-phosphorothioate
  modified_base 2: mod_base = OTHER; note = Adenosine-glycol nucleic acid (GNA), S-isomer phosphorothioate
  modified_base 3: mod_base = OTHER; note = 2'-deoxy-2'-fluorocytidine-3'-phosphate
  modified_base 4: mod_base = OTHER; note = 2'-O-methyladenosine-3'-phosphate
  modified_base 5: mod_base = OTHER; note = 2'-deoxy-2'-fluoroguanosine-3'-phosphate
  modified_base 6: mod_base = OTHER; note = 2'-O-methyluridine-3'-phosphate
  modified_base 7: mod_base = OTHER; note = 2'-deoxy-2'-fluoroguanosine-3'-phosphate
  modified_base 8: mod_base = OTHER; note = 2'-O-methyluridine-3'-phosphate
  modified_base 9: mod_base = OTHER; note = 2'-deoxy-2'-fluorouridine-3'-phosphate
  modified_base 10: mod_base = OTHER; note = 2'-deoxy-2'-fluorocytidine-3'-phosphate
  modified_base 11: mod_base = OTHER; note = 2'-deoxy-2'-fluorouridine-3'-phosphate
  modified_base 12: mod_base = OTHER; note = 2'-O-methyluridine-3'-phosphate
  modified_base 13: mod_base = OTHER; note = 2'-deoxy-2'-fluoroguanosine-3'-phosphate
  modified_base 14: mod_base = OTHER; note = 2'-O-methylcytidine-3'-phosphate
  modified_base 15: mod_base = OTHER; note = 2'-deoxy-2'-fluorouridine-3'-phosphate
  modified_base 16: mod_base = OTHER; note = 2'-O-methylcytidine-3'-phosphate
  modified_base 17: mod_base = OTHER; note = 2'-deoxy-2'-fluorouridine-3'-phosphate
  modified_base 18: mod_base = OTHER; note = 2'-O-methyladenosine-3'-phosphate
  modified_base 19: mod_base = OTHER; note = 2'-deoxy-2'-fluorouridine-3'-phosphate
  modified_base 20: mod_base = OTHER; note = 2'-O-methyladenosine-3'-phosphate
  modified_base 21: mod_base = OTHER; note = 2'-deoxy-2'-fluoroadenosine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
aacagtgttcttgctctataa

SEQ ID NO: 401 - RNA, 21 nt, synthetic construct
  source 1..21: mol_type = other RNA
  modified_base 1: mod_base = OTHER; note = 2'-deoxy-2'-fluoroadenosine-3'-phosphorothioate
  modified_base 2: mod_base = OTHER; note = 2'-O-methyladenosine-3'-phosphorothioate
  modified_base 3: mod_base = OTHER; note = 2'-deoxy-2'-fluorocytidine-3'-phosphate
  modified_base 4: mod_base = OTHER; note = 2'-O-methyladenosine-3'-phosphate
  modified_base 5: mod_base = OTHER; note = 2'-deoxy-2'-fluoroguanosine-3'-phosphate
  modified_base 6: mod_base = OTHER; note = Thymidine-glycol nucleic acid (GNA), S-Isomer
  modified_base 7: mod_base = OTHER; note = 2'-deoxy-2'-fluoroguanosine-3'-phosphate
  modified_base 8: mod_base = OTHER; note = 2'-O-methyluridine-3'-phosphate
  modified_base 9: mod_base = OTHER; note = 2'-deoxy-2'-fluorouridine-3'-phosphate
  modified_base 10: mod_base = OTHER; note = 2'-deoxy-2'-fluorocytidine-3'-phosphate
  modified_base 11: mod_base = OTHER; note = 2'-deoxy-2'-fluorouridine-3'-phosphate
  modified_base 12: mod_base = OTHER; note = 2'-O-methyluridine-3'-phosphate
  modified_base 13: mod_base = OTHER; note = 2'-deoxy-2'-fluoroguanosine-3'-phosphate
  modified_base 14: mod_base = OTHER; note = 2'-O-methylcytidine-3'-phosphate
  modified_base 15: mod_base = OTHER; note = 2'-deoxy-2'-fluorouridine-3'-phosphate
  modified_base 16: mod_base = OTHER; note = 2'-O-methylcytidine-3'-phosphate
  modified_base 17: mod_base = OTHER; note = 2'-deoxy-2'-fluorouridine-3'-phosphate
  modified_base 18: mod_base = OTHER; note = 2'-O-methyladenosine-3'-phosphate
  modified_base 19: mod_base = OTHER; note = 2'-deoxy-2'-fluorouridine-3'-phosphate
  modified_base 20: mod_base = OTHER; note = 2'-O-methyladenosine-3'-phosphate
  modified_base 21: mod_base = OTHER; note = 2'-deoxy-2'-fluoroadenosine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
aacagtgttcttgctctataa

SEQ ID NO: 402 - RNA, 21 nt, synthetic construct
  source 1..21: mol_type = other RNA
  modified_base 1: mod_base = OTHER; note = 2'-deoxy-2'-fluoroadenosine-3'-phosphorothioate
  modified_base 2: mod_base = OTHER; note = 2'-O-methyladenosine-3'-phosphorothioate
  modified_base 3: mod_base = OTHER; note = 2'-deoxy-2'-fluorocytidine-3'-phosphate
  modified_base 4: mod_base = OTHER; note = 2'-O-methyladenosine-3'-phosphate
  modified_base 5: mod_base = OTHER; note = 2'-deoxy-2'-fluoroguanosine-3'-phosphate
  modified_base 6: mod_base = OTHER; note = Thymidine-glycol nucleic acid (GNA), S-Isomer
  modified_base 7: mod_base = OTHER; note = 2'-deoxy-2'-fluoroguanosine-3'-phosphate
  modified_base 8: mod_base = OTHER; note = 2'-O-methyluridine-3'-phosphate
  modified_base 9: mod_base = OTHER; note = 2'-deoxy-2'-fluorouridine-3'-phosphate
  modified_base 10: mod_base = OTHER; note = 2'-deoxy-2'-fluorocytidine-3'-phosphate
  modified_base 11: mod_base = OTHER; note = 2'-deoxy-2'-fluorouridine-3'-phosphate
  modified_base 12: mod_base = OTHER; note = 2'-O-methyluridine-3'-phosphate
  modified_base 13: mod_base = OTHER; note = 2'-deoxy-2'-fluoroguanosine-3'-phosphate
  modified_base 14: mod_base = OTHER; note = 2'-O-methylcytidine-3'-phosphate
  modified_base 15: mod_base = OTHER; note = 2'-deoxy-2'-fluorouridine-3'-phosphate
  modified_base 16: mod_base = OTHER; note = 2'-O-methylcytidine-3'-phosphate
  modified_base 17: mod_base = OTHER; note = 2'-deoxy-2'-fluorouridine-3'-phosphate
  modified_base 18: mod_base = OTHER; note = 2'-O-methyladenosine-3'-phosphate
  modified_base 19: mod_base = OTHER; note = 2'-deoxy-2'-fluorouridine-3'-phosphate
  modified_base 20: mod_base = OTHER; note = 2'-O-methyladenosine-3'-phosphate
  modified_base 21: mod_base = OTHER; note = 2'-deoxy-2'-fluoroadenosine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
aacagtgttcttgctctataa

SEQ ID NO: 403 - RNA, 21 nt, synthetic construct
  source 1..21: mol_type = other RNA
  modified_base 1: mod_base = OTHER; note = 2'-deoxy-2'-fluoroadenosine-3'-phosphorothioate
  modified_base 2: mod_base = OTHER; note = 2'-O-methyladenosine-3'-phosphorothioate
  modified_base 3: mod_base = OTHER; note = 2'-deoxy-2'-fluorocytidine-3'-phosphate
  modified_base 4: mod_base = OTHER; note = 2'-O-methyladenosine-3'-phosphate
  modified_base 5: mod_base = OTHER; note = 2'-deoxy-2'-fluoroguanosine-3'-phosphate
  modified_base 6: mod_base = OTHER; note = 2'-O-methyluridine-3'-phosphate
  modified_base 7: mod_base = OTHER; note = Guanosine-glycol nucleic acid (GNA), S-isomer
  modified_base 8: mod_base = OTHER; note = 2'-O-methyluridine-3'-phosphate
  modified_base 9: mod_base = OTHER; note = 2'-deoxy-2'-fluorouridine-3'-phosphate
  modified_base 10: mod_base = OTHER; note = 2'-deoxy-2'-fluorocytidine-3'-phosphate
  modified_base 11: mod_base = OTHER; note = 2'-deoxy-2'-fluorouridine-3'-phosphate
  modified_base 12: mod_base = OTHER; note = 2'-O-methyluridine-3'-phosphate
  modified_base 13: mod_base = OTHER; note = 2'-deoxy-2'-fluoroguanosine-3'-phosphate
  modified_base 14: mod_base = OTHER; note = 2'-O-methylcytidine-3'-phosphate
  modified_base 15: mod_base = OTHER; note = 2'-deoxy-2'-fluorouridine-3'-phosphate
  modified_base 16: mod_base = OTHER; note = 2'-O-methylcytidine-3'-phosphate
  modified_base 17: mod_base = OTHER; note = 2'-deoxy-2'-fluorouridine-3'-phosphate
  modified_base 18: mod_base = OTHER; note = 2'-O-methyladenosine-3'-phosphate
  modified_base 19: mod_base = OTHER; note = 2'-deoxy-2'-fluorouridine-3'-phosphate
  modified_base 20: mod_base = OTHER; note = 2'-O-methyladenosine-3'-phosphate
  modified_base 21: mod_base = OTHER; note = 2'-deoxy-2'-fluoroadenosine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
aacagtgttcttgctctataa

SEQ ID NO: 404 - RNA, 21 nt, synthetic construct
  source 1..21: mol_type = other RNA
  modified_base 1: mod_base = OTHER; note = 2'-deoxy-2'-fluoroadenosine-3'-phosphorothioate
  modified_base 2: mod_base = OTHER; note = 2'-O-methyladenosine-3'-phosphorothioate
  modified_base 3: mod_base = OTHER; note = 2'-deoxy-2'-fluorocytidine-3'-phosphate
  modified_base 4: mod_base = OTHER; note = 2'-O-methyladenosine-3'-phosphate
  modified_base 5: mod_base = OTHER; note = 2'-deoxy-2'-fluoroguanosine-3'-phosphate
  modified_base 6: mod_base = OTHER; note = 2'-O-methyluridine-3'-phosphate
  modified_base 7: mod_base = OTHER; note = Guanosine-glycol nucleic acid (GNA), S-isomer
  modified_base 8: mod_base = OTHER; note = 2'-O-methyluridine-3'-phosphate
  modified_base 9: mod_base = OTHER; note = 2'-deoxy-2'-fluorouridine-3'-phosphate
  modified_base 10: mod_base = OTHER; note = 2'-deoxy-2'-fluorocytidine-3'-phosphate
  modified_base 11: mod_base = OTHER; note = 2'-deoxy-2'-fluorouridine-3'-phosphate
  modified_base 12: mod_base = OTHER; note = 2'-O-methyluridine-3'-phosphate
  modified_base 13: mod_base = OTHER; note = 2'-deoxy-2'-fluoroguanosine-3'-phosphate
  modified_base 14: mod_base = OTHER; note = 2'-O-methylcytidine-3'-phosphate
  modified_base 15: mod_base = OTHER; note = 2'-deoxy-2'-fluorouridine-3'-phosphate
  modified_base 16: mod_base = OTHER; note = 2'-O-methylcytidine-3'-phosphate
  modified_base 17: mod_base = OTHER; note = 2'-deoxy-2'-fluorouridine-3'-phosphate
  modified_base 18: mod_base = OTHER; note = 2'-O-methyladenosine-3'-phosphate
  modified_base 19: mod_base = OTHER; note = 2'-deoxy-2'-fluorouridine-3'-phosphate
  modified_base 20: mod_base = OTHER; note = 2'-O-methyladenosine-3'-phosphate
  modified_base 21: mod_base = OTHER; note = 2'-deoxy-2'-fluoroadenosine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
aacagtgttcttgctctataa

SEQ ID NO: 405 - RNA, 21 nt, synthetic construct
  source 1..21: mol_type = other RNA
  modified_base 1: mod_base = OTHER; note = 2'-deoxy-2'-fluoroadenosine-3'-phosphorothioate
  modified_base 2: mod_base = OTHER; note = 2'-O-methyladenosine-3'-phosphorothioate
  modified_base 3: mod_base = OTHER; note = 2'-deoxy-2'-fluorocytidine-3'-phosphate
  modified_base 4: mod_base = OTHER; note = 2'-O-methyladenosine-3'-phosphate
  modified_base 5: mod_base = OTHER; note = 2'-deoxy-2'-fluoroguanosine-3'-phosphate
  modified_base 6: mod_base = OTHER; note = 2'-O-methyluridine-3'-phosphate
  modified_base 7: mod_base = OTHER; note = 2'-deoxy-2'-fluoroguanosine-3'-phosphate
  modified_base 8: mod_base = OTHER; note = 2'-O-methyluridine-3'-phosphate
  modified_base 9: mod_base = OTHER; note = 2'-deoxy-2'-fluorouridine-3'-phosphate
  modified_base 10: mod_base = OTHER; note = 2'-deoxy-2'-fluorocytidine-3'-phosphate
  modified_base 11: mod_base = OTHER; note = 2'-deoxy-2'-fluorouridine-3'-phosphate
  modified_base 12: mod_base = OTHER; note = 2'-O-methyluridine-3'-phosphate
  modified_base 13: mod_base = OTHER; note = 2'-deoxy-2'-fluoroguanosine-3'-phosphate
  modified_base 14: mod_base = OTHER; note = 2'-O-methylcytidine-3'-phosphate
  modified_base 15: mod_base = OTHER; note = 2'-deoxy-2'-fluorouridine-3'-phosphate
  modified_base 16: mod_base = OTHER; note = 2'-O-methylcytidine-3'-phosphate
  modified_base 17: mod_base = OTHER; note = 2'-deoxy-2'-fluorouridine-3'-phosphate
  modified_base 18: mod_base = OTHER; note = 2'-O-methyladenosine-3'-phosphate
  modified_base 19: mod_base = OTHER; note = 2'-deoxy-2'-fluorouridine-3'-phosphate
  modified_base 20: mod_base = OTHER; note = 2'-O-methyladenosine-3'-phosphate
  modified_base 21: mod_base = OTHER; note = Adenosine-glycol nucleic acid (GNA), S-isomer ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
aacagtgttcttgctctataa

SEQ ID NO: 406 - RNA, 21 nt, synthetic construct
  source 1..21: mol_type = other RNA
  modified_base 1: mod_base = OTHER; note = 2'-deoxy-2'-fluoroadenosine-3'-phosphorothioate
  modified_base 2: mod_base = OTHER; note = 2'-O-methyladenosine-3'-phosphorothioate
  modified_base 3: mod_base = OTHER; note = 2'-deoxy-2'-fluorocytidine-3'-phosphate
  modified_base 4: mod_base = OTHER; note = 2'-O-methyladenosine-3'-phosphate
  modified_base 5: mod_base = OTHER; note = 2'-deoxy-2'-fluoroguanosine-3'-phosphate
  modified_base 6: mod_base = OTHER; note = 2'-O-methyluridine-3'-phosphate
  modified_base 7: mod_base = OTHER; note = 2'-deoxy-2'-fluoroguanosine-3'-phosphate
  modified_base 8: mod_base = OTHER; note = 2'-O-methyluridine-3'-phosphate
  modified_base 9: mod_base = OTHER; note = 2'-deoxy-2'-fluorouridine-3'-phosphate
  modified_base 10: mod_base = OTHER; note = 2'-deoxy-2'-fluorocytidine-3'-phosphate
  modified_base 11: mod_base = OTHER; note = 2'-deoxy-2'-fluorouridine-3'-phosphate
  modified_base 12: mod_base = OTHER; note = 2'-O-methyluridine-3'-phosphate
  modified_base 13: mod_base = OTHER; note = 2'-deoxy-2'-fluoroguanosine-3'-phosphate
  modified_base 14: mod_base = OTHER; note = 2'-O-methylcytidine-3'-phosphate
  modified_base 15: mod_base = OTHER; note = 2'-deoxy-2'-fluorouridine-3'-phosphate
  modified_base 16: mod_base = OTHER; note = 2'-O-methylcytidine-3'-phosphate
  modified_base 17: mod_base = OTHER; note = 2'-deoxy-2'-fluorouridine-3'-phosphate
  modified_base 18: mod_base = OTHER; note = 2'-O-methyladenosine-3'-phosphate
  modified_base 19: mod_base = OTHER; note = 2'-deoxy-2'-fluorouridine-3'-phosphate
  modified_base 20: mod_base = OTHER; note = 2'-O-methyladenosine-3'-phosphate
  modified_base 21: mod_base = OTHER; note = Adenosine-glycol nucleic acid (GNA), S-isomer ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
aacagtgttcttgctctataa

SEQ ID NO: 407 - RNA, 21 nt, synthetic construct
  source 1..21: mol_type = other RNA
  modified_base 1: mod_base = OTHER; note = 2'-deoxy-2'-fluoroadenosine-3'-phosphorothioate
  modified_base 2: mod_base = OTHER; note = 2'-O-methyladenosine-3'-phosphorothioate
  modified_base 3: mod_base = OTHER; note = 2'-deoxy-2'-fluorocytidine-3'-phosphate
  modified_base 4: mod_base = OTHER; note = 2'-O-methyladenosine-3'-phosphate
  modified_base 5: mod_base = OTHER; note = 2'-deoxy-2'-fluoroguanosine-3'-phosphate
  modified_base 6: mod_base = OTHER; note = 2'-O-methyluridine-3'-phosphate
  modified_base 7: mod_base = OTHER; note = 2'-deoxy-2'-fluoroguanosine-3'-phosphate
  modified_base 8: mod_base = OTHER; note = 2'-O-methyluridine-3'-phosphate
  modified_base 9: mod_base = OTHER; note = 2'-deoxy-2'-fluorouridine-3'-phosphate
  modified_base 10: mod_base = OTHER; note = 2'-deoxy-2'-fluorocytidine-3'-phosphate
  modified_base 11: mod_base = OTHER; note = Thymidine-glycol nucleic acid (GNA), S-Isomer
  modified_base 12: mod_base = OTHER; note = 2'-O-methyluridine-3'-phosphate
  modified_base 13: mod_base = OTHER; note = 2'-deoxy-2'-fluoroguanosine-3'-phosphate
  modified_base 14: mod_base = OTHER; note = 2'-O-methylcytidine-3'-phosphate
  modified_base 15: mod_base = OTHER; note = 2'-deoxy-2'-fluorouridine-3'-phosphate
  modified_base 16: mod_base = OTHER; note = 2'-O-methylcytidine-3'-phosphate
  modified_base 17: mod_base = OTHER; note = 2'-deoxy-2'-fluorouridine-3'-phosphate
  modified_base 18: mod_base = OTHER; note = 2'-O-methyladenosine-3'-phosphate
  modified_base 19: mod_base = OTHER; note = 2'-deoxy-2'-fluorouridine-3'-phosphate
  modified_base 20: mod_base = OTHER; note = 2'-O-methyladenosine-3'-phosphate
  modified_base 21: mod_base = OTHER; note = 2'-deoxy-2'-fluoroadenosine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
aacagtgttcttgctctataa

SEQ ID NO: 408 - RNA, 21 nt, synthetic construct
  source 1..21: mol_type = other RNA
  modified_base 1: mod_base = OTHER; note = 2'-deoxy-2'-fluoroadenosine-3'-phosphorothioate
  modified_base 2: mod_base = OTHER; note = 2'-O-methyladenosine-3'-phosphorothioate
  modified_base 3: mod_base = OTHER; note = 2'-deoxy-2'-fluorocytidine-3'-phosphate
  modified_base 4: mod_base = OTHER; note = 2'-O-methyladenosine-3'-phosphate
  modified_base 5: mod_base = OTHER; note = 2'-deoxy-2'-fluoroguanosine-3'-phosphate
  modified_base 6: mod_base = OTHER; note = 2'-O-methyluridine-3'-phosphate
  modified_base 7: mod_base = OTHER; note = 2'-deoxy-2'-fluoroguanosine-3'-phosphate
  modified_base 8: mod_base = OTHER; note = 2'-O-methyluridine-3'-phosphate
  modified_base 9: mod_base = OTHER; note = 2'-deoxy-2'-fluorouridine-3'-phosphate
  modified_base 10: mod_base = OTHER; note = 2'-deoxy-2'-fluorocytidine-3'-phosphate
  modified_base 11: mod_base = OTHER; note = 2'-deoxy-2'-fluorouridine-3'-phosphate
  modified_base 12: mod_base = OTHER; note = Thymidine-glycol nucleic acid (GNA), S-Isomer
  modified_base 13: mod_base = OTHER; note = 2'-deoxy-2'-fluoroguanosine-3'-phosphate
  modified_base 14: mod_base = OTHER; note = 2'-O-methylcytidine-3'-phosphate
  modified_base 15: mod_base = OTHER; note = 2'-deoxy-2'-fluorouridine-3'-phosphate
  modified_base 16: mod_base = OTHER; note = 2'-O-methylcytidine-3'-phosphate
  modified_base 17: mod_base = OTHER; note = 2'-deoxy-2'-fluorouridine-3'-phosphate
  modified_base 18: mod_base = OTHER; note = 2'-O-methyladenosine-3'-phosphate
  modified_base 19: mod_base = OTHER; note = 2'-deoxy-2'-fluorouridine-3'-phosphate
  modified_base 20: mod_base = OTHER; note = 2'-O-methyladenosine-3'-phosphate
  modified_base 21: mod_base = OTHER; note = 2'-deoxy-2'-fluoroadenosine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
aacagtgttcttgctctataa

SEQ ID NO: 409 - RNA, 21 nt, synthetic construct
  source 1..21: mol_type = other RNA
  modified_base 1: mod_base = OTHER; note = 2'-deoxy-2'-fluoroadenosine-3'-phosphorothioate
  modified_base 2: mod_base = OTHER; note = 2'-O-methyladenosine-3'-phosphorothioate
  modified_base 3: mod_base = OTHER; note = 2'-deoxy-2'-fluorocytidine-3'-phosphate
  modified_base 4: mod_base = OTHER; note = 2'-O-methyladenosine-3'-phosphate
  modified_base 5: mod_base = OTHER; note = 2'-deoxy-2'-fluoroguanosine-3'-phosphate
  modified_base 6: mod_base = OTHER; note = 2'-O-methyluridine-3'-phosphate
  modified_base 7: mod_base = OTHER; note = 2'-deoxy-2'-fluoroguanosine-3'-phosphate
  modified_base 8: mod_base = OTHER; note = 2'-O-methyluridine-3'-phosphate
  modified_base 9: mod_base = OTHER; note = 2'-deoxy-2'-fluorouridine-3'-phosphate
  modified_base 10: mod_base = OTHER; note = 2'-deoxy-2'-fluorocytidine-3'-phosphate
  modified_base 11: mod_base = OTHER; note = Thymidine-glycol nucleic acid (GNA), S-Isomer
  modified_base 12: mod_base = OTHER; note = 2'-O-methyluridine-3'-phosphate
  modified_base 13: mod_base = OTHER; note = 2'-deoxy-2'-fluoroguanosine-3'-phosphate
  modified_base 14: mod_base = OTHER; note = 2'-O-methylcytidine-3'-phosphate
  modified_base 15: mod_base = OTHER; note = 2'-deoxy-2'-fluorouridine-3'-phosphate
  modified_base 16: mod_base = OTHER; note = 2'-O-methylcytidine-3'-phosphate
  modified_base 17: mod_base = OTHER; note = 2'-deoxy-2'-fluorouridine-3'-phosphate
  modified_base 18: mod_base = OTHER; note = 2'-O-methyladenosine-3'-phosphate
  modified_base 19: mod_base = OTHER; note = 2'-deoxy-2'-fluorouridine-3'-phosphate
  modified_base 20: mod_base = OTHER; note = 2'-O-methyladenosine-3'-phosphate
  modified_base 21: mod_base = OTHER; note = 2'-deoxy-2'-fluoroadenosine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
aacagtgttcttgctctataa

SEQ ID NO: 410 - RNA, 21 nt, synthetic construct
  source 1..21: mol_type = other RNA
  modified_base 1: mod_base = OTHER; note = 2'-deoxy-2'-fluoroadenosine-3'-phosphorothioate
  modified_base 2: mod_base = OTHER; note = 2'-O-methyladenosine-3'-phosphorothioate
  modified_base 3: mod_base = OTHER; note = 2'-deoxy-2'-fluorocytidine-3'-phosphate
  modified_base 4: mod_base = OTHER; note = 2'-O-methyladenosine-3'-phosphate
  modified_base 5: mod_base = OTHER; note = 2'-deoxy-2'-fluoroguanosine-3'-phosphate
  modified_base 6: mod_base = OTHER; note = 2'-O-methyluridine-3'-phosphate
  modified_base 7: mod_base = OTHER; note = 2'-deoxy-2'-fluoroguanosine-3'-phosphate
  modified_base 8: mod_base = OTHER; note = 2'-O-methyluridine-3'-phosphate
  modified_base 9: mod_base = OTHER; note = 2'-deoxy-2'-fluorouridine-3'-phosphate
  modified_base 10: mod_base = OTHER; note = 2'-deoxy-2'-fluorocytidine-3'-phosphate
  modified_base 11: mod_base = OTHER; note = Thymidine-glycol nucleic acid (GNA), S-Isomer
  modified_base 12: mod_base = OTHER; note = 2'-O-methyluridine-3'-phosphate
  modified_base 13: mod_base = OTHER; note = 2'-deoxy-2'-fluoroguanosine-3'-phosphate
  modified_base 14: mod_base = OTHER; note = 2'-O-methylcytidine-3'-phosphate
  modified_base 15: mod_base = OTHER; note = 2'-deoxy-2'-fluorouridine-3'-phosphate
  modified_base 16: mod_base = OTHER; note = 2'-O-methylcytidine-3'-phosphate
  modified_base 17: mod_base = OTHER; note = 2'-deoxy-2'-fluorouridine-3'-phosphate
  modified_base 18: mod_base = OTHER; note = 2'-O-methyladenosine-3'-phosphate
  modified_base 19: mod_base = OTHER; note = 2'-deoxy-2'-fluorouridine-3'-phosphate
  modified_base 20: mod_base = OTHER; note = 2'-O-methyladenosine-3'-phosphate
  modified_base 21: mod_base = OTHER; note = 2'-deoxy-2'-fluoroadenosine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
aacagtgttcttgctctataa

SEQ ID NO: 411 - RNA, 21 nt, synthetic construct
  source 1..21: mol_type = other RNA
  modified_base 1: mod_base = OTHER; note = 2'-deoxy-2'-fluoroadenosine-3'-phosphorothioate
  modified_base 2: mod_base = OTHER; note = 2'-O-methyladenosine-3'-phosphorothioate
  modified_base 3: mod_base = OTHER; note = 2'-deoxy-2'-fluorocytidine-3'-phosphate
  modified_base 4: mod_base = OTHER; note = 2'-O-methyladenosine-3'-phosphate
  modified_base 5: mod_base = OTHER; note = 2'-deoxy-2'-fluoroguanosine-3'-phosphate
  modified_base 6: mod_base = OTHER; note = 2'-O-methyluridine-3'-phosphate
  modified_base 7: mod_base = OTHER; note = 2'-deoxy-2'-fluoroguanosine-3'-phosphate
  modified_base 8: mod_base = OTHER; note = 2'-O-methyluridine-3'-phosphate
  modified_base 9: mod_base = OTHER; note = 2'-deoxy-2'-fluorouridine-3'-phosphate
  modified_base 10: mod_base = OTHER; note = 2'-deoxy-2'-fluorocytidine-3'-phosphate
  modified_base 11: mod_base = OTHER; note = 2'-deoxy-2'-fluorouridine-3'-phosphate
  modified_base 12: mod_base = OTHER; note = 2'-O-methyluridine-3'-phosphate
  modified_base 13: mod_base = OTHER; note = 2'-deoxy-2'-fluoroguanosine-3'-phosphate
  modified_base 14: mod_base = OTHER; note = 2'-O-methylcytidine-3'-phosphate
  modified_base 15: mod_base = OTHER; note = 2'-deoxy-2'-fluorouridine-3'-phosphate
  modified_base 16: mod_base = OTHER; note = Cytidine-glycol nucleic acid (GNA), S-isomer
  modified_base 17: mod_base = OTHER; note = 2'-deoxy-2'-fluorouridine-3'-phosphate
  modified_base 18: mod_base = OTHER; note = 2'-O-methyladenosine-3'-phosphate
  modified_base 19: mod_base = OTHER; note = 2'-deoxy-2'-fluorouridine-3'-phosphate
  modified_base 20: mod_base = OTHER; note = 2'-O-methyladenosine-3'-phosphate
  modified_base 21: mod_base = OTHER; note = 2'-deoxy-2'-fluoroadenosine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
aacagtgttcttgctctataa

SEQ ID NO: 412 - RNA, 23 nt, synthetic construct
  source 1..23: mol_type = other RNA
  modified_base 1: mod_base = OTHER; note = 2'-O-methyluridine-3'-phosphorothioate
  modified_base 2: mod_base = OTHER; note = 2'-deoxy-2'-fluorouridine-3'-phosphorothioate
  modified_base 3: mod_base = OTHER; note = 2'-O-methyladenosine-3'-phosphate
  modified_base 4: mod_base = OTHER; note = 2'-deoxy-2'-fluorouridine-3'-phosphate
  modified_base 5: mod_base = OTHER; note = 2'-O-methyladenosine-3'-phosphate
  modified_base 6: mod_base = OTHER; note = 2'-deoxy-2'-fluoroguanosine-3'-phosphate
  modified_base 7: mod_base = OTHER; note = 2'-O-methyladenosine-3'-phosphate
  modified_base 8: mod_base = OTHER; note = 2'-deoxy-2'-fluoroguanosine-3'-phosphate
  modified_base 9: mod_base = OTHER; note = 2'-O-methylcytidine-3'-phosphate
  modified_base 10: mod_base = OTHER; note = 2'-deoxy-2'-fluoroadenosine-3'-phosphate
  modified_base 11: mod_base = OTHER; note = 2'-O-methyladenosine-3'-phosphate
  modified_base 12: mod_base = OTHER; note = 2'-O-methylguanosine-3'-phosphate
  modified_base 13: mod_base = OTHER; note = 2'-O-methyladenosine-3'-phosphate
  modified_base 14: mod_base = OTHER; note = 2'-deoxy-2'-fluoroadenosine-3'-phosphate
  modified_base 15: mod_base = OTHER; note = 2'-O-methylcytidine-3'-phosphate
  modified_base 16: mod_base = OTHER; note = 2'-deoxy-2'-fluoroadenosine-3'-phosphate
  modified_base 17: mod_base = OTHER; note = 2'-O-methylcytidine-3'-phosphate
  modified_base 18: mod_base = OTHER; note = 2'-deoxy-2'-fluorouridine-3'-phosphate
  modified_base 19: mod_base = OTHER; note = 2'-O-methylguanosine-3'-phosphate
  modified_base 20: mod_base = OTHER; note = 2'-deoxy-2'-fluorouridine-3'-phosphate
  modified_base 21: mod_base = OTHER; note = 2'-O-methyluridine-3'-phosphorothioate
  modified_base 22: mod_base = OTHER; note = 2'-O-methyluridine-3'-phosphorothioate
  modified_base 23: mod_base = OTHER; note = 2'-O-methyluridine
ttatagagcaagaacactgtttt

SEQ ID NO: 413 - RNA, 23 nt, synthetic construct
  source 1..23: mol_type = other RNA
  modified_base 1: mod_base = OTHER; note = Thymidine-glycol nucleic acid (GNA), S-Isomer phosphorothioate
  modified_base 2: mod_base = OTHER; note = 2'-deoxy-2'-fluorouridine-3'-phosphorothioate
  modified_base 3: mod_base = OTHER; note = 2'-O-methyladenosine-3'-phosphate
  modified_base 4: mod_base = OTHER; note = 2'-deoxy-2'-fluorouridine-3'-phosphate
  modified_base 5: mod_base = OTHER; note = 2'-O-methyladenosine-3'-phosphate
  modified_base 6: mod_base = OTHER; note = 2'-deoxy-2'-fluoroguanosine-3'-phosphate
  modified_base 7: mod_base = OTHER; note = 2'-O-methyladenosine-3'-phosphate
  modified_base 8: mod_base = OTHER; note = 2'-deoxy-2'-fluoroguanosine-3'-phosphate
  modified_base 9: mod_base = OTHER; note = 2'-O-methylcytidine-3'-phosphate
  modified_base 10: mod_base = OTHER; note = 2'-deoxy-2'-fluoroadenosine-3'-phosphate
  modified_base 11: mod_base = OTHER; note = 2'-O-methyladenosine-3'-phosphate
  modified_base 12: mod_base = OTHER; note = 2'-O-methylguanosine-3'-phosphate
  modified_base 13: mod_base = OTHER; note = 2'-O-methyladenosine-3'-phosphate
  modified_base 14: mod_base = OTHER; note = 2'-deoxy-2'-fluoroadenosine-3'-phosphate
  modified_base 15: mod_base = OTHER; note = 2'-O-methylcytidine-3'-phosphate
  modified_base 16: mod_base = OTHER; note = 2'-deoxy-2'-fluoroadenosine-3'-phosphate
  modified_base 17: mod_base = OTHER; note = 2'-O-methylcytidine-3'-phosphate
  modified_base 18: mod_base = OTHER; note = 2'-deoxy-2'-fluorouridine-3'-phosphate
  modified_base 19: mod_base = OTHER; note = 2'-O-methylguanosine-3'-phosphate
  modified_base 20: mod_base = OTHER; note = 2'-deoxy-2'-fluorouridine-3'-phosphate
  modified_base 21: mod_base = OTHER; note = 2'-O-methyluridine-3'-phosphorothioate
  modified_base 22: mod_base = OTHER; note = 2'-O-methyluridine-3'-phosphorothioate
  modified_base 23: mod_base = OTHER; note = 2'-O-methyluridine
ttatagagcaagaacactgtttt

SEQ ID NO: 414 - RNA, 23 nt, synthetic construct
  source 1..23: mol_type = other RNA
  modified_base 1: mod_base = OTHER; note = 2'-O-methyluridine-3'-phosphorothioate
  modified_base 2: mod_base = OTHER; note = Thymidine-glycol nucleic acid (GNA), S-Isomer phosphorothioate
  modified_base 3: mod_base = OTHER; note = 2'-O-methyladenosine-3'-phosphate
  modified_base 4: mod_base = OTHER; note = 2'-deoxy-2'-fluorouridine-3'-phosphate
  modified_base 5: mod_base = OTHER; note = 2'-O-methyladenosine-3'-phosphate
  modified_base 6: mod_base = OTHER; note = 2'-deoxy-2'-fluoroguanosine-3'-phosphate
  modified_base 7: mod_base = OTHER; note = 2'-O-methyladenosine-3'-phosphate
  modified_base 8: mod_base = OTHER; note = 2'-deoxy-2'-fluoroguanosine-3'-phosphate
  modified_base 9: mod_base = OTHER; note = 2'-O-methylcytidine-3'-phosphate
  modified_base 10: mod_base = OTHER; note = 2'-deoxy-2'-fluoroadenosine-3'-phosphate
  modified_base 11: mod_base = OTHER; note = 2'-O-methyladenosine-3'-phosphate
  modified_base 12: mod_base = OTHER; note = 2'-O-methylguanosine-3'-phosphate
  modified_base 13: mod_base = OTHER; note = 2'-O-methyladenosine-3'-phosphate
  modified_base 14: mod_base = OTHER; note = 2'-deoxy-2'-fluoroadenosine-3'-phosphate
  modified_base 15: mod_base = OTHER; note = 2'-O-methylcytidine-3'-phosphate
  modified_base 16: mod_base = OTHER; note = 2'-deoxy-2'-fluoroadenosine-3'-phosphate
  modified_base 17: mod_base = OTHER; note = 2'-O-methylcytidine-3'-phosphate
  modified_base 18: mod_base = OTHER; note = 2'-deoxy-2'-fluorouridine-3'-phosphate
  modified_base 19: mod_base = OTHER; note = 2'-O-methylguanosine-3'-phosphate
  modified_base 20: mod_base = OTHER; note = 2'-deoxy-2'-fluorouridine-3'-phosphate
  modified_base 21: mod_base = OTHER; note = 2'-O-methyluridine-3'-phosphorothioate
  modified_base 22: mod_base = OTHER; note = 2'-O-methyluridine-3'-phosphorothioate
  modified_base 23: mod_base = OTHER; note = 2'-O-methyluridine
ttatagagcaagaacactgtttt

SEQ ID NO: 415 - RNA, 23 nt, synthetic construct
  source 1..23: mol_type = other RNA
  modified_base 1: mod_base = OTHER; note = 2'-O-methyluridine-3'-phosphorothioate
  modified_base 2: mod_base = OTHER; note = 2'-deoxy-2'-fluorouridine-3'-phosphorothioate
  modified_base 3: mod_base = OTHER; note = Adenosine-glycol nucleic acid (GNA), S-isomer
  modified_base 4: mod_base = OTHER; note = 2'-deoxy-2'-fluorouridine-3'-phosphate
  modified_base 5: mod_base = OTHER; note = 2'-O-methyladenosine-3'-phosphate
  modified_base 6: mod_base = OTHER; note = 2'-deoxy-2'-fluoroguanosine-3'-phosphate
  modified_base 7: mod_base = OTHER; note = 2'-O-methyladenosine-3'-phosphate
  modified_base 8: mod_base = OTHER; note = 2'-deoxy-2'-fluoroguanosine-3'-phosphate
  modified_base 9: mod_base = OTHER; note = 2'-O-methylcytidine-3'-phosphate
  modified_base 10: mod_base = OTHER; note = 2'-deoxy-2'-fluoroadenosine-3'-phosphate
  modified_base 11: mod_base = OTHER; note = 2'-O-methyladenosine-3'-phosphate
  modified_base 12: mod_base = OTHER; note = 2'-O-methylguanosine-3'-phosphate
  modified_base 13: mod_base = OTHER; note = 2'-O-methyladenosine-3'-phosphate
  modified_base 14: mod_base = OTHER; note = 2'-deoxy-2'-fluoroadenosine-3'-phosphate
  modified_base 15: mod_base = OTHER; note = 2'-O-methylcytidine-3'-phosphate
  modified_base 16: mod_base = OTHER; note = 2'-deoxy-2'-fluoroadenosine-3'-phosphate
  modified_base 17: mod_base = OTHER; note = 2'-O-methylcytidine-3'-phosphate
  modified_base 18: mod_base = OTHER; note = 2'-deoxy-2'-fluorouridine-3'-phosphate
  modified_base 19: mod_base = OTHER; note = 2'-O-methylguanosine-3'-phosphate
  modified_base 20: mod_base = OTHER; note = 2'-deoxy-2'-fluorouridine-3'-phosphate
  modified_base 21: mod_base = OTHER; note = 2'-O-methyluridine-3'-phosphorothioate
  modified_base 22: mod_base = OTHER; note = 2'-O-methyluridine-3'-phosphorothioate
  modified_base 23: mod_base = OTHER; note = 2'-O-methyluridine
ttatagagcaagaacactgtttt

SEQ ID NO: 416 - RNA, 23 nt, synthetic construct
  source 1..23: mol_type = other RNA
  modified_base 1: mod_base = OTHER; note = 2'-O-methyluridine-3'-phosphorothioate
  modified_base 2: mod_base = OTHER; note = 2'-deoxy-2'-fluorouridine-3'-phosphorothioate
  modified_base 3: mod_base = OTHER; note = 2'-O-methyladenosine-3'-phosphate
  modified_base 4: mod_base = OTHER; note = Thymidine-glycol nucleic acid (GNA), S-Isomer
  modified_base 5: mod_base = OTHER; note = 2'-O-methyladenosine-3'-phosphate
  modified_base 6: mod_base = OTHER; note = 2'-deoxy-2'-fluoroguanosine-3'-phosphate
  modified_base 7: mod_base = OTHER; note = 2'-O-methyladenosine-3'-phosphate
  modified_base 8: mod_base = OTHER; note = 2'-deoxy-2'-fluoroguanosine-3'-phosphate
  modified_base 9: mod_base = OTHER; note = 2'-O-methylcytidine-3'-phosphate
  modified_base 10: mod_base = OTHER; note = 2'-deoxy-2'-fluoroadenosine-3'-phosphate
  modified_base 11: mod_base = OTHER; note = 2'-O-methyladenosine-3'-phosphate
  modified_base 12: mod_base = OTHER; note = 2'-O-methylguanosine-3'-phosphate
  modified_base 13: mod_base = OTHER; note = 2'-O-methyladenosine-3'-phosphate
  modified_base 14: mod_base = OTHER; note = 2'-deoxy-2'-fluoroadenosine-3'-phosphate
  modified_base 15: mod_base = OTHER; note = 2'-O-methylcytidine-3'-phosphate
  modified_base 16: mod_base = OTHER; note = 2'-deoxy-2'-fluoroadenosine-3'-phosphate
  modified_base 17: mod_base = OTHER; note = 2'-O-methylcytidine-3'-phosphate
  modified_base 18: mod_base = OTHER; note = 2'-deoxy-2'-fluorouridine-3'-phosphate
  modified_base 19: mod_base = OTHER; note = 2'-O-methylguanosine-3'-phosphate
  modified_base 20: mod_base = OTHER; note = 2'-deoxy-2'-fluorouridine-3'-phosphate
  modified_base 21: mod_base = OTHER; note = 2'-O-methyluridine-3'-phosphorothioate
  modified_base 22: mod_base = OTHER; note = 2'-O-methyluridine-3'-phosphorothioate
  modified_base 23: mod_base = OTHER; note = 2'-O-methyluridine
ttatagagcaagaacactgtttt

SEQ ID NO: 417 - RNA, 23 nt, synthetic construct
  source 1..23: mol_type = other RNA
  modified_base 1: mod_base = OTHER; note = 2'-O-methyluridine-3'-phosphorothioate
  modified_base 2: mod_base = OTHER; note = 2'-deoxy-2'-fluorouridine-3'-phosphorothioate
  modified_base 3: mod_base = OTHER; note = 2'-O-methyladenosine-3'-phosphate
  modified_base 4: mod_base = OTHER; note = 2'-deoxy-2'-fluorouridine-3'-phosphate
  modified_base 5: mod_base = OTHER; note = Adenosine-glycol nucleic acid (GNA), S-isomer
  modified_base 6: mod_base = OTHER; note = 2'-deoxy-2'-fluoroguanosine-3'-phosphate
  modified_base 7: mod_base = OTHER; note = 2'-O-methyladenosine-3'-phosphate
  modified_base 8: mod_base = OTHER; note = 2'-deoxy-2'-fluoroguanosine-3'-phosphate
  modified_base 9: mod_base = OTHER; note = 2'-O-methylcytidine-3'-phosphate
  modified_base 10: mod_base = OTHER; note = 2'-deoxy-2'-fluoroadenosine-3'-phosphate
  modified_base 11: mod_base = OTHER; note = 2'-O-methyladenosine-3'-phosphate
  modified_base 12: mod_base = OTHER; note = 2'-O-methylguanosine-3'-phosphate
  modified_base 13: mod_base = OTHER; note = 2'-O-methyladenosine-3'-phosphate
  modified_base 14: mod_base = OTHER; note = 2'-deoxy-2'-fluoroadenosine-3'-phosphate
  modified_base 15: mod_base = OTHER; note = 2'-O-methylcytidine-3'-phosphate
  modified_base 16: mod_base = OTHER; note = 2'-deoxy-2'-fluoroadenosine-3'-phosphate
  modified_base 17: mod_base = OTHER; note = 2'-O-methylcytidine-3'-phosphate
  modified_base 18: mod_base = OTHER; note = 2'-deoxy-2'-fluorouridine-3'-phosphate
  modified_base 19: mod_base = OTHER; note = 2'-O-methylguanosine-3'-phosphate
  modified_base 20: mod_base = OTHER; note = 2'-deoxy-2'-fluorouridine-3'-phosphate
  modified_base 21: mod_base = OTHER; note = 2'-O-methyluridine-3'-phosphorothioate
  modified_base 22: mod_base = OTHER; note = 2'-O-methyluridine-3'-phosphorothioate
  modified_base 23: mod_base = OTHER; note = 2'-O-methyluridine
ttatagagcaagaacactgtttt

SEQ ID NO: 418 - RNA, 23 nt, synthetic construct
  source 1..23: mol_type = other RNA
  modified_base 1: mod_base = OTHER; note = 2'-O-methyluridine-3'-phosphorothioate
  modified_base 2: mod_base = OTHER; note = 2'-deoxy-2'-fluorouridine-3'-phosphorothioate
  modified_base 3: mod_base = OTHER; note = 2'-O-methyladenosine-3'-phosphate
  modified_base 4: mod_base = OTHER; note = 2'-deoxy-2'-fluorouridine-3'-phosphate
  modified_base 5: mod_base = OTHER; note = 2'-O-methyladenosine-3'-phosphate
  modified_base 6: mod_base = OTHER; note = Guanosine-glycol nucleic acid (GNA), S-isomer
  modified_base 7: mod_base = OTHER; note = 2'-O-methyladenosine-3'-phosphate
  modified_base 8: mod_base = OTHER; note = 2'-deoxy-2'-fluoroguanosine-3'-phosphate
  modified_base 9: mod_base = OTHER; note = 2'-O-methylcytidine-3'-phosphate
  modified_base 10: mod_base = OTHER; note = 2'-deoxy-2'-fluoroadenosine-3'-phosphate
  modified_base 11: mod_base = OTHER; note = 2'-O-methyladenosine-3'-phosphate
  modified_base 12: mod_base = OTHER; note = 2'-O-methylguanosine-3'-phosphate
  modified_base 13: mod_base = OTHER; note = 2'-O-methyladenosine-3'-phosphate
  modified_base 14: mod_base = OTHER; note = 2'-deoxy-2'-fluoroadenosine-3'-phosphate
  modified_base 15: mod_base = OTHER; note = 2'-O-methylcytidine-3'-phosphate
  modified_base 16: mod_base = OTHER; note = 2'-deoxy-2'-fluoroadenosine-3'-phosphate
  modified_base 17: mod_base = OTHER; note = 2'-O-methylcytidine-3'-phosphate
  modified_base 18: mod_base = OTHER; note = 2'-deoxy-2'-fluorouridine-3'-phosphate
  modified_base 19: mod_base = OTHER; note = 2'-O-methylguanosine-3'-phosphate
  modified_base 20: mod_base = OTHER; note = 2'-deoxy-2'-fluorouridine-3'-phosphate
  modified_base 21: mod_base = OTHER; note = 2'-O-methyluridine-3'-phosphorothioate
  modified_base 22: mod_base = OTHER; note = 2'-O-methyluridine-3'-phosphorothioate
  modified_base 23: mod_base = OTHER; note = 2'-O-methyluridine
ttatagagcaagaacactgtttt

SEQ ID NO: 419 - RNA, 23 nt, synthetic construct
  source 1..23: mol_type = other RNA
  modified_base 1: mod_base = OTHER; note = 2'-O-methyluridine-3'-phosphorothioate
  modified_base 2: mod_base = OTHER; note = 2'-deoxy-2'-fluorouridine-3'-phosphorothioate
  modified_base 3: mod_base = OTHER; note = 2'-O-methyladenosine-3'-phosphate
  modified_base 4: mod_base = OTHER; note = 2'-deoxy-2'-fluorouridine-3'-phosphate
  modified_base 5: mod_base = OTHER; note = 2'-O-methyladenosine-3'-phosphate
  modified_base 6: mod_base = OTHER; note = 2'-deoxy-2'-fluoroguanosine-3'-phosphate
  modified_base 7: mod_base = OTHER; note = Adenosine-glycol nucleic acid (GNA), S-isomer
  modified_base 8: mod_base = OTHER; note = 2'-deoxy-2'-fluoroguanosine-3'-phosphate
  modified_base 9: mod_base = OTHER; note = 2'-O-methylcytidine-3'-phosphate
  modified_base 10: mod_base = OTHER; note = 2'-deoxy-2'-fluoroadenosine-3'-phosphate
  modified_base 11: mod_base = OTHER; note = 2'-O-methyladenosine-3'-phosphate
  modified_base 12: mod_base = OTHER; note = 2'-O-methylguanosine-3'-phosphate
  modified_base 13: mod_base = OTHER; note = 2'-O-methyladenosine-3'-phosphate
  modified_base 14: mod_base = OTHER; note = 2'-deoxy-2'-fluoroadenosine-3'-phosphate
  modified_base 15: mod_base = OTHER; note = 2'-O-methylcytidine-3'-phosphate
  modified_base 16: mod_base = OTHER; note = 2'-deoxy-2'-fluoroadenosine-3'-phosphate
  modified_base 17: mod_base = OTHER; note = 2'-O-methylcytidine-3'-phosphate
  modified_base 18: mod_base = OTHER; note = 2'-deoxy-2'-fluorouridine-3'-phosphate
  modified_base 19: mod_base = OTHER; note = 2'-O-methylguanosine-3'-phosphate
  modified_base 20: mod_base = OTHER; note = 2'-deoxy-2'-fluorouridine-3'-phosphate
  modified_base 21: mod_base = OTHER; note = 2'-O-methyluridine-3'-phosphorothioate
  modified_base 22: mod_base = OTHER; note = 2'-O-methyluridine-3'-phosphorothioate
  modified_base 23: mod_base = OTHER; note = 2'-O-methyluridine
ttatagagcaagaacactgtttt

SEQ ID NO: 420 - RNA, 23 nt, synthetic construct
  source 1..23: mol_type = other RNA
  modified_base 1: mod_base = OTHER; note = 2'-O-methyluridine-3'-phosphorothioate
  modified_base 2: mod_base = OTHER; note = 2'-deoxy-2'-fluorouridine-3'-phosphorothioate
  modified_base 3: mod_base = OTHER; note = 2'-O-methyladenosine-3'-phosphate
  modified_base 4: mod_base = OTHER; note = 2'-deoxy-2'-fluorouridine-3'-phosphate
  modified_base 5: mod_base = OTHER; note = 2'-O-methyladenosine-3'-phosphate
  modified_base 6: mod_base = OTHER; note = 2'-deoxy-2'-fluoroguanosine-3'-phosphate
  modified_base 7: mod_base = OTHER; note = 2'-O-methyladenosine-3'-phosphate
  modified_base 8: mod_base = OTHER; note = Guanosine-glycol nucleic acid (GNA), S-isomer
  modified_base 9: mod_base = OTHER; note = 2'-O-methylcytidine-3'-phosphate
  modified_base 10: mod_base = OTHER; note = 2'-deoxy-2'-fluoroadenosine-3'-phosphate
  modified_base 11: mod_base = OTHER; note = 2'-O-methyladenosine-3'-phosphate
  modified_base 12: mod_base = OTHER; note = 2'-O-methylguanosine-3'-phosphate
  modified_base 13: mod_base = OTHER; note = 2'-O-methyladenosine-3'-phosphate
  modified_base 14: mod_base = OTHER; note = 2'-deoxy-2'-fluoroadenosine-3'-phosphate
  modified_base 15: mod_base = OTHER; note = 2'-O-methylcytidine-3'-phosphate
  modified_base 16: mod_base = OTHER; note = 2'-deoxy-2'-fluoroadenosine-3'-phosphate
  modified_base 17: mod_base = OTHER; note = 2'-O-methylcytidine-3'-phosphate
  modified_base 18: mod_base = OTHER; note = 2'-deoxy-2'-fluorouridine-3'-phosphate
  modified_base 19: mod_base = OTHER; note = 2'-O-methylguanosine-3'-phosphate
  modified_base 20: mod_base = OTHER; note = 2'-deoxy-2'-fluorouridine-3'-phosphate
  modified_base 21: mod_base = OTHER; note = 2'-O-methyluridine-3'-phosphorothioate
  modified_base 22: mod_base = OTHER; note = 2'-O-methyluridine-3'-phosphorothioate
  modified_base 23: mod_base = OTHER; note = 2'-O-methyluridine
ttatagagcaagaacactgtttt

SEQ ID NO: 421 - RNA, 23 nt, synthetic construct
  source 1..23: mol_type = other RNA
  modified_base 1: mod_base = OTHER; note = 2'-O-methyluridine-3'-phosphorothioate
  modified_base 2: mod_base = OTHER; note = 2'-deoxy-2'-fluorouridine-3'-phosphorothioate
  modified_base 3: mod_base = OTHER; note = 2'-O-methyladenosine-3'-phosphate
  modified_base 4: mod_base = OTHER; note = 2'-deoxy-2'-fluorouridine-3'-phosphate
  modified_base 5: mod_base = OTHER; note = 2'-O-methyladenosine-3'-phosphate
  modified_base 6: mod_base = OTHER; note = 2'-deoxy-2'-fluoroguanosine-3'-phosphate
  modified_base 7: mod_base = OTHER; note = 2'-O-methyladenosine-3'-phosphate
  modified_base 8: mod_base = OTHER; note = 2'-deoxy-2'-fluoroguanosine-3'-phosphate
  modified_base 9: mod_base = OTHER; note = Cytidine-glycol nucleic acid (GNA), S-isomer
  modified_base 10: mod_base = OTHER; note = 2'-deoxy-2'-fluoroadenosine-3'-phosphate
  modified_base 11: mod_base = OTHER; note = 2'-O-methyladenosine-3'-phosphate
  modified_base 12: mod_base = OTHER; note = 2'-O-methylguanosine-3'-phosphate
  modified_base 13: mod_base = OTHER; note = 2'-O-methyladenosine-3'-phosphate
  modified_base 14: mod_base = OTHER; note = 2'-deoxy-2'-fluoroadenosine-3'-phosphate
  modified_base 15: mod_base = OTHER; note = 2'-O-methylcytidine-3'-phosphate
  modified_base 16: mod_base = OTHER; note = 2'-deoxy-2'-fluoroadenosine-3'-phosphate
  modified_base 17: mod_base = OTHER; note = 2'-O-methylcytidine-3'-phosphate
  modified_base 18: mod_base = OTHER; note = 2'-deoxy-2'-fluorouridine-3'-phosphate
  modified_base 19: mod_base = OTHER; note = 2'-O-methylguanosine-3'-phosphate
  modified_base 20: mod_base = OTHER; note = 2'-deoxy-2'-fluorouridine-3'-phosphate
  modified_base 21: mod_base = OTHER; note = 2'-O-methyluridine-3'-phosphorothioate
  modified_base 22: mod_base = OTHER; note = 2'-O-methyluridine-3'-phosphorothioate
  modified_base 23: mod_base = OTHER; note = 2'-O-methyluridine
ttatagagcaagaacactgtttt

SEQ ID NO: 422 - RNA, 23 nt, synthetic construct
  source 1..23: mol_type = other RNA
  modified_base 1: mod_base = OTHER; note = 2'-O-methyluridine-3'-phosphorothioate
  modified_base 2: mod_base = OTHER; note = 2'-deoxy-2'-fluorouridine-3'-phosphorothioate
  modified_base 3: mod_base = OTHER; note = 2'-O-methyladenosine-3'-phosphate
  modified_base 4: mod_base = OTHER; note = 2'-deoxy-2'-fluorouridine-3'-phosphate
  modified_base 5: mod_base = OTHER; note = 2'-O-methyladenosine-3'-phosphate
  modified_base 6: mod_base = OTHER; note = 2'-deoxy-2'-fluoroguanosine-3'-phosphate
  modified_base 7: mod_base = OTHER; note = 2'-O-methyladenosine-3'-phosphate
  modified_base 8: mod_base = OTHER; note = 2'-deoxy-2'-fluoroguanosine-3'-phosphate
  modified_base 9: mod_base = OTHER; note = 2'-O-methylcytidine-3'-phosphate
  modified_base 10: mod_base = OTHER; note = Adenosine-glycol nucleic acid (GNA), S-isomer
  modified_base 11: mod_base = OTHER; note = 2'-O-methyladenosine-3'-phosphate
  modified_base 12: mod_base = OTHER; note = 2'-O-methylguanosine-3'-phosphate
  modified_base 13: mod_base = OTHER; note = 2'-O-methyladenosine-3'-phosphate
  modified_base 14: mod_base = OTHER; note = 2'-deoxy-2'-fluoroadenosine-3'-phosphate
  modified_base 15: mod_base = OTHER; note = 2'-O-methylcytidine-3'-phosphate
  modified_base 16: mod_base = OTHER; note = 2'-deoxy-2'-fluoroadenosine-3'-phosphate
  modified_base 17: mod_base = OTHER; note = 2'-O-methylcytidine-3'-phosphate
  modified_base 18: mod_base = OTHER; note = 2'-deoxy-2'-fluorouridine-3'-phosphate
  modified_base 19: mod_base = OTHER; note = 2'-O-methylguanosine-3'-phosphate
  modified_base 20: mod_base = OTHER; note = 2'-deoxy-2'-fluorouridine-3'-phosphate
  modified_base 21: mod_base = OTHER; note = 2'-O-methyluridine-3'-phosphorothioate
  modified_base 22: mod_base = OTHER; note = 2'-O-methyluridine-3'-phosphorothioate
  modified_base 23: mod_base = OTHER; note = 2'-O-methyluridine
ttatagagcaagaacactgtttt

SEQ ID NO: 423 - RNA, 23 nt, synthetic construct
  source 1..23: mol_type = other RNA
  modified_base 1: mod_base = OTHER; note = 2'-O-methyluridine-3'-phosphorothioate
  modified_base 2: mod_base = OTHER; note = 2'-deoxy-2'-fluorouridine-3'-phosphorothioate
  modified_base 3: mod_base = OTHER; note = 2'-O-methyladenosine-3'-phosphate
  modified_base 4: mod_base = OTHER; note = 2'-deoxy-2'-fluorouridine-3'-phosphate
  modified_base 5: mod_base = OTHER; note = 2'-O-methyladenosine-3'-phosphate
  modified_base 6: mod_base = OTHER; note = 2'-deoxy-2'-fluoroguanosine-3'-phosphate
  modified_base 7: mod_base = OTHER; note = 2'-O-methyladenosine-3'-phosphate
  modified_base 8: mod_base = OTHER; note = 2'-deoxy-2'-fluoroguanosine-3'-phosphate
  modified_base 9: mod_base = OTHER; note = 2'-O-methylcytidine-3'-phosphate
  modified_base 10: mod_base = OTHER; note = 2'-deoxy-2'-fluoroadenosine-3'-phosphate
  modified_base 11: mod_base = OTHER; note = Adenosine-glycol nucleic acid (GNA), S-isomer
  modified_base 12: mod_base = OTHER; note = 2'-O-methylguanosine-3'-phosphate
  modified_base 13: mod_base = OTHER; note = 2'-O-methyladenosine-3'-phosphate
  modified_base 14: mod_base = OTHER; note = 2'-deoxy-2'-fluoroadenosine-3'-phosphate
  modified_base 15: mod_base = OTHER; note = 2'-O-methylcytidine-3'-phosphate
  modified_base 16: mod_base = OTHER; note = 2'-deoxy-2'-fluoroadenosine-3'-phosphate
  modified_base 17: mod_base = OTHER; note = 2'-O-methylcytidine-3'-phosphate
  modified_base 18: mod_base = OTHER; note = 2'-deoxy-2'-fluorouridine-3'-phosphate
  modified_base 19: mod_base = OTHER; note = 2'-O-methylguanosine-3'-phosphate
  modified_base 20: mod_base = OTHER; note = 2'-deoxy-2'-fluorouridine-3'-phosphate
  modified_base 21: mod_base = OTHER; note = 2'-O-methyluridine-3'-phosphorothioate
  modified_base 22: mod_base = OTHER; note = 2'-O-methyluridine-3'-phosphorothioate
  modified_base 23: mod_base = OTHER; note = 2'-O-methyluridine
ttatagagcaagaacactgtttt

SEQ ID NO: 424 - RNA, 23 nt, synthetic construct
  source 1..23: mol_type = other RNA
  modified_base 1: mod_base = OTHER; note = 2'-O-methyluridine-3'-phosphorothioate
  modified_base 2: mod_base = OTHER; note = 2'-deoxy-2'-fluorouridine-3'-phosphorothioate
  modified_base 3: mod_base = OTHER; note = 2'-O-methyladenosine-3'-phosphate
  modified_base 4: mod_base = OTHER; note = 2'-deoxy-2'-fluorouridine-3'-phosphate
  modified_base 5: mod_base = OTHER; note = 2'-O-methyladenosine-3'-phosphate
  modified_base 6: mod_base = OTHER; note = 2'-deoxy-2'-fluoroguanosine-3'-phosphate
  modified_base 7: mod_base = OTHER; note = 2'-O-methyladenosine-3'-phosphate
  modified_base 8: mod_base = OTHER; note = 2'-deoxy-2'-fluoroguanosine-3'-phosphate
  modified_base 9: mod_base = OTHER; note = 2'-O-methylcytidine-3'-phosphate
  modified_base 10: mod_base = OTHER; note = 2'-deoxy-2'-fluoroadenosine-3'-phosphate
  modified_base 11: mod_base = OTHER; note = 2'-O-methyladenosine-3'-phosphate
  modified_base 12: mod_base = OTHER; note = Guanosine-glycol nucleic acid (GNA), S-isomer
  modified_base 13: mod_base = OTHER; note = 2'-O-methyladenosine-3'-phosphate
  modified_base 14: mod_base = OTHER; note = 2'-deoxy-2'-fluoroadenosine-3'-phosphate
  modified_base 15: mod_base = OTHER; note = 2'-O-methylcytidine-3'-phosphate
  modified_base 16: mod_base = OTHER; note = 2'-deoxy-2'-fluoroadenosine-3'-phosphate
  modified_base 17: mod_base = OTHER; note = 2'-O-methylcytidine-3'-phosphate
  modified_base 18: mod_base = OTHER; note = 2'-deoxy-2'-fluorouridine-3'-phosphate
  modified_base 19: mod_base = OTHER; note = 2'-O-methylguanosine-3'-phosphate
  modified_base 20: mod_base = OTHER; note = 2'-deoxy-2'-fluorouridine-3'-phosphate
  modified_base 21: mod_base = OTHER; note = 2'-O-methyluridine-3'-phosphorothioate
  modified_base 22: mod_base = OTHER; note = 2'-O-methyluridine-3'-phosphorothioate
  modified_base 23: mod_base = OTHER; note = 2'-O-methyluridine
ttatagagcaagaacactgtttt

SEQ ID NO: 425 - RNA, 23 nt, synthetic construct
  source 1..23: mol_type = other RNA
  modified_base 1: mod_base = OTHER; note = 2'-O-methyluridine-3'-phosphorothioate
  modified_base 2: mod_base = OTHER; note = 2'-deoxy-2'-fluorouridine-3'-phosphorothioate
  modified_base 3: mod_base = OTHER; note = 2'-O-methyladenosine-3'-phosphate
  modified_base 4: mod_base = OTHER; note = 2'-deoxy-2'-fluorouridine-3'-phosphate
  modified_base 5: mod_base = OTHER; note = 2'-O-methyladenosine-3'-phosphate
  modified_base 6: mod_base = OTHER; note = 2'-deoxy-2'-fluoroguanosine-3'-phosphate
  modified_base 7: mod_base = OTHER; note = 2'-O-methyladenosine-3'-phosphate
  modified_base 8: mod_base = OTHER; note = 2'-deoxy-2'-fluoroguanosine-3'-phosphate
  modified_base 9: mod_base = OTHER; note = 2'-O-methylcytidine-3'-phosphate
  modified_base 10: mod_base = OTHER; note = 2'-deoxy-2'-fluoroadenosine-3'-phosphate
  modified_base 11: mod_base = OTHER; note = 2'-O-methyladenosine-3'-phosphate
  modified_base 12: mod_base = OTHER; note = 2'-O-methylguanosine-3'-phosphate
  modified_base 13: mod_base = OTHER; note = Adenosine-glycol nucleic acid (GNA), S-isomer
  modified_base 14: mod_base = OTHER; note = 2'-deoxy-2'-fluoroadenosine-3'-phosphate
  modified_base 15: mod_base = OTHER; note = 2'-O-methylcytidine-3'-phosphate
  modified_base 16: mod_base = OTHER; note = 2'-deoxy-2'-fluoroadenosine-3'-phosphate
  modified_base 17: mod_base = OTHER; note = 2'-O-methylcytidine-3'-phosphate
  modified_base 18: mod_base = OTHER; note = 2'-deoxy-2'-fluorouridine-3'-phosphate
  modified_base 19: mod_base = OTHER; note = 2'-O-methylguanosine-3'-phosphate
  modified_base 20: mod_base = OTHER; note = 2'-deoxy-2'-fluorouridine-3'-phosphate
  modified_base 21: mod_base = OTHER; note = 2'-O-methyluridine-3'-phosphorothioate
  modified_base 22: mod_base = OTHER; note = 2'-O-methyluridine-3'-phosphorothioate
  modified_base 23: mod_base = OTHER; note = 2'-O-methyluridine
ttatagagcaagaacactgtttt

SEQ ID NO: 426 - RNA, 23 nt, synthetic construct
  source 1..23: mol_type = other RNA
  modified_base 1: mod_base = OTHER; note = 2'-O-methyluridine-3'-phosphorothioate
  modified_base 2: mod_base = OTHER; note = 2'-deoxy-2'-fluorouridine-3'-phosphorothioate
  modified_base 3: mod_base = OTHER; note = 2'-O-methyladenosine-3'-phosphate
  modified_base 4: mod_base = OTHER; note = 2'-deoxy-2'-fluorouridine-3'-phosphate
  modified_base 5: mod_base = OTHER; note = 2'-O-methyladenosine-3'-phosphate
  modified_base 6: mod_base = OTHER; note = 2'-deoxy-2'-fluoroguanosine-3'-phosphate
  modified_base 7: mod_base = OTHER; note = 2'-O-methyladenosine-3'-phosphate
  modified_base 8: mod_base = OTHER; note = 2'-deoxy-2'-fluoroguanosine-3'-phosphate
  modified_base 9: mod_base = OTHER; note = 2'-O-methylcytidine-3'-phosphate
  modified_base 10: mod_base = OTHER; note = 2'-deoxy-2'-fluoroadenosine-3'-phosphate
  modified_base 11: mod_base = OTHER; note = 2'-O-methyladenosine-3'-phosphate
  modified_base 12: mod_base = OTHER; note = 2'-O-methylguanosine-3'-phosphate
  modified_base 13: mod_base = OTHER; note = 2'-O-methyladenosine-3'-phosphate
  modified_base 14: mod_base = OTHER; note = Adenosine-glycol nucleic acid (GNA), S-isomer
  modified_base 15: mod_base = OTHER; note = 2'-O-methylcytidine-3'-phosphate
  modified_base 16: mod_base = OTHER; note = 2'-deoxy-2'-fluoroadenosine-3'-phosphate
  modified_base 17: mod_base = OTHER; note = 2'-O-methylcytidine-3'-phosphate
  modified_base 18: mod_base = OTHER; note = 2'-deoxy-2'-fluorouridine-3'-phosphate
  modified_base 19: mod_base = OTHER; note = 2'-O-methylguanosine-3'-phosphate
  modified_base 20: mod_base = OTHER; note = 2'-deoxy-2'-fluorouridine-3'-phosphate
  modified_base 21: mod_base = OTHER; note = 2'-O-methyluridine-3'-phosphorothioate
  modified_base 22: mod_base = OTHER; note = 2'-O-methyluridine-3'-phosphorothioate
  modified_base 23: mod_base = OTHER; note = 2'-O-methyluridine
ttatagagcaagaacactgtttt

SEQ ID NO: 427 - RNA, 23 nt, synthetic construct
  source 1..23: mol_type = other RNA
  modified_base 1: mod_base = OTHER; note = 2'-O-methyluridine-3'-phosphorothioate
  modified_base 2: mod_base = OTHER; note = 2'-deoxy-2'-fluorouridine-3'-phosphorothioate
  modified_base 3: mod_base = OTHER; note = 2'-O-methyladenosine-3'-phosphate
  modified_base 4: mod_base = OTHER; note = 2'-deoxy-2'-fluorouridine-3'-phosphate
  modified_base 5: mod_base = OTHER; note = 2'-O-methyladenosine-3'-phosphate
  modified_base 6: mod_base = OTHER; note = 2'-deoxy-2'-fluoroguanosine-3'-phosphate
  modified_base 7: mod_base = OTHER; note = 2'-O-methyladenosine-3'-phosphate
  modified_base 8: mod_base = OTHER; note = 2'-deoxy-2'-fluoroguanosine-3'-phosphate
  modified_base 9: mod_base = OTHER; note = 2'-O-methylcytidine-3'-phosphate
  modified_base 10: mod_base = OTHER; note = 2'-deoxy-2'-fluoroadenosine-3'-phosphate
  modified_base 11: mod_base = OTHER; note = 2'-O-methyladenosine-3'-phosphate
  modified_base 12: mod_base = OTHER; note = 2'-O-methylguanosine-3'-phosphate
  modified_base 13: mod_base = OTHER; note = 2'-O-methyladenosine-3'-phosphate
  modified_base 14: mod_base = OTHER; note = 2'-deoxy-2'-fluoroadenosine-3'-phosphate
  modified_base 15: mod_base = OTHER; note = Cytidine-glycol nucleic acid (GNA), S-isomer
  modified_base 16: mod_base = OTHER; note = 2'-deoxy-2'-fluoroadenosine-3'-phosphate
  modified_base 17: mod_base = OTHER; note = 2'-O-methylcytidine-3'-phosphate
  modified_base 18: mod_base = OTHER; note = 2'-deoxy-2'-fluorouridine-3'-phosphate
  modified_base 19: mod_base = OTHER; note = 2'-O-methylguanosine-3'-phosphate
  modified_base 20: mod_base = OTHER; note = 2'-deoxy-2'-fluorouridine-3'-phosphate
  modified_base 21: mod_base = OTHER; note = 2'-O-methyluridine-3'-phosphorothioate
  modified_base 22: mod_base = OTHER; note = 2'-O-methyluridine-3'-phosphorothioate
  modified_base 23: mod_base = OTHER; note = 2'-O-methyluridine
ttatagagcaagaacactgtttt

SEQ ID NO: 428 - RNA, 23 nt, synthetic construct
  source 1..23: mol_type = other RNA
  modified_base 1: mod_base = OTHER; note = 2'-O-methyluridine-3'-phosphorothioate
  modified_base 2: mod_base = OTHER; note = 2'-deoxy-2'-fluorouridine-3'-phosphorothioate
  modified_base 3: mod_base = OTHER; note = 2'-O-methyladenosine-3'-phosphate
  modified_base 4: mod_base = OTHER; note = 2'-deoxy-2'-fluorouridine-3'-phosphate
  modified_base 5: mod_base = OTHER; note = 2'-O-methyladenosine-3'-phosphate
  modified_base 6: mod_base = OTHER; note = 2'-deoxy-2'-fluoroguanosine-3'-phosphate
  modified_base 7: mod_base = OTHER; note = 2'-O-methyladenosine-3'-phosphate
  modified_base 8: mod_base = OTHER; note = 2'-deoxy-2'-fluoroguanosine-3'-phosphate
  modified_base 9: mod_base = OTHER; note = 2'-O-methylcytidine-3'-phosphate
  modified_base 10: mod_base = OTHER; note = 2'-deoxy-2'-fluoroadenosine-3'-phosphate
  modified_base 11: mod_base = OTHER; note = 2'-O-methyladenosine-3'-phosphate
  modified_base 12: mod_base = OTHER; note = 2'-O-methylguanosine-3'-phosphate
  modified_base 13: mod_base = OTHER; note = 2'-O-methyladenosine-3'-phosphate
  modified_base 14: mod_base = OTHER; note = 2'-deoxy-2'-fluoroadenosine-3'-phosphate
  modified_base 15: mod_base = OTHER; note = 2'-O-methylcytidine-3'-phosphate
  modified_base 16: mod_base = OTHER; note = Adenosine-glycol nucleic acid (GNA), S-isomer
  modified_base 17: mod_base = OTHER; note = 2'-O-methylcytidine-3'-phosphate
  modified_base 18: mod_base = OTHER; note = 2'-deoxy-2'-fluorouridine-3'-phosphate
  modified_base 19: mod_base = OTHER; note = 2'-O-methylguanosine-3'-phosphate
  modified_base 20: mod_base = OTHER; note = 2'-deoxy-2'-fluorouridine-3'-phosphate
  modified_base 21: mod_base = OTHER; note = 2'-O-methyluridine-3'-phosphorothioate
  modified_base 22: mod_base = OTHER; note = 2'-O-methyluridine-3'-phosphorothioate
  modified_base 23: mod_base = OTHER; note = 2'-O-methyluridine
ttatagagcaagaacactgtttt

SEQ ID NO: 429 - RNA, 23 nt, synthetic construct
  source 1..23: mol_type = other RNA
  modified_base 1: mod_base = OTHER; note = 2'-O-methyluridine-3'-phosphorothioate
  modified_base 2: mod_base = OTHER; note = 2'-deoxy-2'-fluorouridine-3'-phosphorothioate
  modified_base 3: mod_base = OTHER; note = 2'-O-methyladenosine-3'-phosphate
  modified_base 4: mod_base = OTHER; note = 2'-deoxy-2'-fluorouridine-3'-phosphate
  modified_base 5: mod_base = OTHER; note = 2'-O-methyladenosine-3'-phosphate
  modified_base 6: mod_base = OTHER; note = 2'-deoxy-2'-fluoroguanosine-3'-phosphate
  modified_base 7: mod_base = OTHER; note = 2'-O-methyladenosine-3'-phosphate
  modified_base 8: mod_base = OTHER; note = 2'-deoxy-2'-fluoroguanosine-3'-phosphate
  modified_base 9: mod_base = OTHER; note = 2'-O-methylcytidine-3'-phosphate
  modified_base 10: mod_base = OTHER; note = 2'-deoxy-2'-fluoroadenosine-3'-phosphate
  modified_base 11: mod_base = OTHER; note = 2'-O-methyladenosine-3'-phosphate
  modified_base 12: mod_base = OTHER; note = 2'-O-methylguanosine-3'-phosphate
  modified_base 13: mod_base = OTHER; note = 2'-O-methyladenosine-3'-phosphate
  modified_base 14: mod_base = OTHER; note = 2'-deoxy-2'-fluoroadenosine-3'-phosphate
  modified_base 15: mod_base = OTHER; note = 2'-O-methylcytidine-3'-phosphate
  modified_base 16: mod_base = OTHER; note = 2'-deoxy-2'-fluoroadenosine-3'-phosphate
  modified_base 17: mod_base = OTHER; note = Cytidine-glycol nucleic acid (GNA), S-isomer
  modified_base 18: mod_base = OTHER; note = 2'-deoxy-2'-fluorouridine-3'-phosphate
  modified_base 19: mod_base = OTHER; note = 2'-O-methylguanosine-3'-phosphate
  modified_base 20: mod_base = OTHER; note = 2'-deoxy-2'-fluorouridine-3'-phosphate
  modified_base 21: mod_base = OTHER; note = 2'-O-methyluridine-3'-phosphorothioate
  modified_base 22: mod_base = OTHER; note = 2'-O-methyluridine-3'-phosphorothioate
  modified_base 23: mod_base = OTHER; note = 2'-O-methyluridine
ttatagagcaagaacactgtttt

SEQ ID NO: 430 - RNA, 23 nt, synthetic construct
  source 1..23: mol_type = other RNA
  modified_base 1: mod_base = OTHER; note = 2'-O-methyluridine-3'-phosphorothioate
  modified_base 2: mod_base = OTHER; note = 2'-deoxy-2'-fluorouridine-3'-phosphorothioate
  modified_base 3: mod_base = OTHER; note = 2'-O-methyladenosine-3'-phosphate
  modified_base 4: mod_base = OTHER; note = 2'-deoxy-2'-fluorouridine-3'-phosphate
  modified_base 5: mod_base = OTHER; note = 2'-O-methyladenosine-3'-phosphate
  modified_base 6: mod_base = OTHER; note = 2'-deoxy-2'-fluoroguanosine-3'-phosphate
  modified_base 7: mod_base = OTHER; note = 2'-O-methyladenosine-3'-phosphate
  modified_base 8: mod_base = OTHER; note = 2'-deoxy-2'-fluoroguanosine-3'-phosphate
  modified_base 9: mod_base = OTHER; note = 2'-O-methylcytidine-3'-phosphate
  modified_base 10: mod_base = OTHER; note = 2'-deoxy-2'-fluoroadenosine-3'-phosphate
  modified_base 11: mod_base = OTHER; note = 2'-O-methyladenosine-3'-phosphate
  modified_base 12: mod_base = OTHER; note = 2'-O-methylguanosine-3'-phosphate
  modified_base 13: mod_base = OTHER; note = 2'-O-methyladenosine-3'-phosphate
  modified_base 14: mod_base = OTHER; note = 2'-deoxy-2'-fluoroadenosine-3'-phosphate
  modified_base 15: mod_base = OTHER; note = 2'-O-methylcytidine-3'-phosphate
  modified_base 16: mod_base = OTHER; note = 2'-deoxy-2'-fluoroadenosine-3'-phosphate
  modified_base 17: mod_base = OTHER; note = 2'-O-methylcytidine-3'-phosphate
  modified_base 18: mod_base = OTHER; note = Thymidine-glycol nucleic acid (GNA), S-Isomer
  modified_base 19: mod_base = OTHER; note = 2'-O-methylguanosine-3'-phosphate
  modified_base 20: mod_base = OTHER; note = 2'-deoxy-2'-fluorouridine-3'-phosphate
  modified_base 21: mod_base = OTHER; note = 2'-O-methyluridine-3'-phosphorothioate
  modified_base 22: mod_base = OTHER; note = 2'-O-methyluridine-3'-phosphorothioate
  modified_base 23: mod_base = OTHER; note = 2'-O-methyluridine
ttatagagcaagaacactgtttt

SEQ ID NO: 431 - RNA, 23 nt, synthetic construct
  source 1..23: mol_type = other RNA
  modified_base 1: mod_base = OTHER; note = 2'-O-methyluridine-3'-phosphorothioate
  modified_base 2: mod_base = OTHER; note = 2'-deoxy-2'-fluorouridine-3'-phosphorothioate
  modified_base 3: mod_base = OTHER; note = 2'-O-methyladenosine-3'-phosphate
  modified_base 4: mod_base = OTHER; note = 2'-deoxy-2'-fluorouridine-3'-phosphate
  modified_base 5: mod_base = OTHER; note = 2'-O-methyladenosine-3'-phosphate
  modified_base 6: mod_base = OTHER; note = 2'-deoxy-2'-fluoroguanosine-3'-phosphate
  modified_base 7: mod_base = OTHER; note = 2'-O-methyladenosine-3'-phosphate
  modified_base 8: mod_base = OTHER; note = 2'-deoxy-2'-fluoroguanosine-3'-phosphate
  modified_base 9: mod_base = OTHER; note = 2'-O-methylcytidine-3'-phosphate
  modified_base 10: mod_base = OTHER; note = 2'-deoxy-2'-fluoroadenosine-3'-phosphate
  modified_base 11: mod_base = OTHER; note = 2'-O-methyladenosine-3'-phosphate
  modified_base 12: mod_base = OTHER; note = 2'-O-methylguanosine-3'-phosphate
  modified_base 13: mod_base = OTHER; note = 2'-O-methyladenosine-3'-phosphate
  modified_base 14: mod_base = OTHER; note = 2'-deoxy-2'-fluoroadenosine-3'-phosphate
  modified_base 15: mod_base = OTHER; note = 2'-O-methylcytidine-3'-phosphate
  modified_base 16: mod_base = OTHER; note = 2'-deoxy-2'-fluoroadenosine-3'-phosphate
  modified_base 17: mod_base = OTHER; note = 2'-O-methylcytidine-3'-phosphate
  modified_base 18: mod_base = OTHER; note = 2'-deoxy-2'-fluorouridine-3'-phosphate
  modified_base 19: mod_base = OTHER; note = Guanosine-glycol nucleic acid (GNA), S-isomer
  modified_base 20: mod_base = OTHER; note = 2'-deoxy-2'-fluorouridine-3'-phosphate
  modified_base 21: mod_base = OTHER; note = 2'-O-methyluridine-3'-phosphorothioate
  modified_base 22: mod_base = OTHER; note = 2'-O-methyluridine-3'-phosphorothioate
  modified_base 23: mod_base = OTHER; note = 2'-O-methyluridine
ttatagagcaagaacactgtttt

SEQ ID NO: 432 - RNA, 23 nt, synthetic construct
  source 1..23: mol_type = other RNA
  modified_base 1: mod_base = OTHER; note = 2'-O-methyluridine-3'-phosphorothioate
  modified_base 2: mod_base = OTHER; note = 2'-deoxy-2'-fluorouridine-3'-phosphorothioate
  modified_base 3: mod_base = OTHER; note = 2'-O-methyladenosine-3'-phosphate
  modified_base 4: mod_base = OTHER; note = 2'-deoxy-2'-fluorouridine-3'-phosphate
  modified_base 5: mod_base = OTHER; note = 2'-O-methyladenosine-3'-phosphate
  modified_base 6: mod_base = OTHER; note = 2'-deoxy-2'-fluoroguanosine-3'-phosphate
  modified_base 7: mod_base = OTHER; note = 2'-O-methyladenosine-3'-phosphate
  modified_base 8: mod_base = OTHER; note = 2'-deoxy-2'-fluoroguanosine-3'-phosphate
  modified_base 9: mod_base = OTHER; note = 2'-O-methylcytidine-3'-phosphate
  modified_base 10: mod_base = OTHER; note = 2'-deoxy-2'-fluoroadenosine-3'-phosphate
  modified_base 11: mod_base = OTHER; note = 2'-O-methyladenosine-3'-phosphate
  modified_base 12: mod_base = OTHER; note = 2'-O-methylguanosine-3'-phosphate
  modified_base 13: mod_base = OTHER; note = 2'-O-methyladenosine-3'-phosphate
  modified_base 14: mod_base = OTHER; note = 2'-deoxy-2'-fluoroadenosine-3'-phosphate
  modified_base 15: mod_base = OTHER; note = 2'-O-methylcytidine-3'-phosphate
  modified_base 16: mod_base = OTHER; note = 2'-deoxy-2'-fluoroadenosine-3'-phosphate
  modified_base 17: mod_base = OTHER; note = 2'-O-methylcytidine-3'-phosphate
  modified_base 18: mod_base = OTHER; note = 2'-deoxy-2'-fluorouridine-3'-phosphate
  modified_base 19: mod_base = OTHER; note = 2'-O-methylguanosine-3'-phosphate
  modified_base 20: mod_base = OTHER; note = Thymidine-glycol nucleic acid (GNA), S-Isomer
  modified_base 21: mod_base = OTHER; note = 2'-O-methyluridine-3'-phosphorothioate
  modified_base 22: mod_base = OTHER; note = 2'-O-methyluridine-3'-phosphorothioate
  modified_base 23: mod_base = OTHER; note = 2'-O-methyluridine
ttatagagcaagaacactgtttt

SEQ ID NO: 433 - RNA, 23 nt, synthetic construct
  source 1..23: mol_type = other RNA
  modified_base 1: mod_base = OTHER; note = 2'-O-methyluridine-3'-phosphorothioate
  modified_base 2: mod_base = OTHER; note = 2'-deoxy-2'-fluorouridine-3'-phosphorothioate
  modified_base 3: mod_base = OTHER; note = 2'-O-methyladenosine-3'-phosphate
  modified_base 4: mod_base = OTHER; note = 2'-deoxy-2'-fluorouridine-3'-phosphate
  modified_base 5: mod_base = OTHER; note = 2'-O-methyladenosine-3'-phosphate
  modified_base 6: mod_base = OTHER; note = 2'-deoxy-2'-fluoroguanosine-3'-phosphate
  modified_base 7: mod_base = OTHER; note = 2'-O-methyladenosine-3'-phosphate
  modified_base 8: mod_base = OTHER; note = 2'-deoxy-2'-fluoroguanosine-3'-phosphate
  modified_base 9: mod_base = OTHER; note = 2'-O-methylcytidine-3'-phosphate
  modified_base 10: mod_base = OTHER; note = 2'-deoxy-2'-fluoroadenosine-3'-phosphate
  modified_base 11: mod_base = OTHER; note = 2'-O-methyladenosine-3'-phosphate
  modified_base 12: mod_base = OTHER; note = 2'-O-methylguanosine-3'-phosphate
  modified_base 13: mod_base = OTHER; note = 2'-O-methyladenosine-3'-phosphate
  modified_base 14: mod_base = OTHER; note = 2'-deoxy-2'-fluoroadenosine-3'-phosphate
  modified_base 15: mod_base = OTHER; note = 2'-O-methylcytidine-3'-phosphate
  modified_base 16: mod_base = OTHER; note = 2'-deoxy-2'-fluoroadenosine-3'-phosphate
  modified_base 17: mod_base = OTHER; note = 2'-O-methylcytidine-3'-phosphate
  modified_base 18: mod_base = OTHER; note = 2'-deoxy-2'-fluorouridine-3'-phosphate
  modified_base 19: mod_base = OTHER; note = 2'-O-methylguanosine-3'-phosphate
  modified_base 20: mod_base = OTHER; note = 2'-deoxy-2'-fluorouridine-3'-phosphate
  modified_base 21: mod_base = OTHER; note = Thymidine-glycol nucleic acid (GNA), S-Isomer phosphorothioate
  modified_base 22: mod_base = OTHER; note = 2'-O-methyluridine-3'-phosphorothioate
  modified_base 23: mod_base = OTHER; note = 2'-O-methyluridine
ttatagagcaagaacactgtttt

SEQ ID NO: 434 - RNA, 23 nt, synthetic construct
  source 1..23: mol_type = other RNA
  modified_base 1: mod_base = OTHER; note = 2'-O-methyluridine-3'-phosphorothioate
  modified_base 2: mod_base = OTHER; note = 2'-deoxy-2'-fluorouridine-3'-phosphorothioate
  modified_base 3: mod_base = OTHER; note = 2'-O-methyladenosine-3'-phosphate
  modified_base 4: mod_base = OTHER; note = 2'-deoxy-2'-fluorouridine-3'-phosphate
  modified_base 5: mod_base = OTHER; note = 2'-O-methyladenosine-3'-phosphate
  modified_base 6: mod_base = OTHER; note = Guanosine-glycol nucleic acid (GNA), S-isomer
  modified_base 7: mod_base = OTHER; note = 2'-O-methyladenosine-3'-phosphate
  modified_base 8: mod_base = OTHER; note = 2'-deoxy-2'-fluoroguanosine-3'-phosphate
  modified_base 9: mod_base = OTHER; note = 2'-O-methylcytidine-3'-phosphate
  modified_base 10: mod_base = OTHER; note = 2'-deoxy-2'-fluoroadenosine-3'-phosphate
  modified_base 11: mod_base = OTHER; note = 2'-O-methyladenosine-3'-phosphate
  modified_base 12: mod_base = OTHER; note = 2'-O-methylguanosine-3'-phosphate
  modified_base 13: mod_base = OTHER; note = 2'-O-methyladenosine-3'-phosphate
  modified_base 14: mod_base = OTHER; note = 2'-deoxy-2'-fluoroadenosine-3'-phosphate
  modified_base 15: mod_base = OTHER; note = 2'-O-methylcytidine-3'-phosphate
  modified_base 16: mod_base = OTHER; note = 2'-deoxy-2'-fluoroadenosine-3'-phosphate
  modified_base 17: mod_base = OTHER; note = 2'-O-methylcytidine-3'-phosphate
  modified_base 18: mod_base = OTHER; note = 2'-deoxy-2'-fluorouridine-3'-phosphate
  modified_base 19: mod_base = OTHER; note = 2'-O-methylguanosine-3'-phosphate
  modified_base 20: mod_base = OTHER; note = 2'-deoxy-2'-fluorouridine-3'-phosphate
  modified_base 21: mod_base = OTHER; note = 2'-O-methyluridine-3'-phosphorothioate
  modified_base 22: mod_base = OTHER; note = 2'-O-methyluridine-3'-phosphorothioate
  modified_base 23: mod_base = OTHER; note = 2'-O-methyluridine
ttatagagcaagaacactgtttt

SEQ ID NO: 435 - RNA, 23 nt, synthetic construct
  source 1..23: mol_type = other RNA
  modified_base 1: mod_base = OTHER; note = 2'-O-methyluridine-3'-phosphorothioate
  modified_base 2: mod_base = OTHER; note = 2'-deoxy-2'-fluorouridine-3'-phosphorothioate
  modified_base 3: mod_base = OTHER; note = 2'-O-methyladenosine-3'-phosphate
  modified_base 4: mod_base = OTHER; note = 2'-deoxy-2'-fluorouridine-3'-phosphate
  modified_base 5: mod_base = OTHER; note = 2'-O-methyladenosine-3'-phosphate
  modified_base 6: mod_base = OTHER; note = Guanosine-glycol nucleic acid (GNA), S-isomer
  modified_base 7: mod_base = OTHER; note = 2'-O-methyladenosine-3'-phosphate
  modified_base 8: mod_base = OTHER; note = 2'-deoxy-2'-fluoroguanosine-3'-phosphate
  modified_base 9: mod_base = OTHER; note = 2'-O-methylcytidine-3'-phosphate
  modified_base 10: mod_base = OTHER; note = 2'-deoxy-2'-fluoroadenosine-3'-phosphate
  modified_base 11: mod_base = OTHER; note = 2'-O-methyladenosine-3'-phosphate
  modified_base 12: mod_base = OTHER; note = 2'-O-methylguanosine-3'-phosphate
  modified_base 13: mod_base = OTHER; note = 2'-O-methyladenosine-3'-phosphate
  modified_base 14: mod_base = OTHER; note = 2'-deoxy-2'-fluoroadenosine-3'-phosphate
  modified_base 15: mod_base = OTHER; note = 2'-O-methylcytidine-3'-phosphate
  modified_base 16: mod_base = OTHER; note = 2'-deoxy-2'-fluoroadenosine-3'-phosphate
  modified_base 17: mod_base = OTHER; note = 2'-O-methylcytidine-3'-phosphate
  modified_base 18: mod_base = OTHER; note = 2'-deoxy-2'-fluorouridine-3'-phosphate
  modified_base 19: mod_base = OTHER; note = 2'-O-methylguanosine-3'-phosphate
  modified_base 20: mod_base = OTHER; note = 2'-deoxy-2'-fluorouridine-3'-phosphate
  modified_base 21: mod_base = OTHER; note = 2'-O-methyluridine-3'-phosphorothioate
  modified_base 22: mod_base = OTHER; note = 2'-O-methyluridine-3'-phosphorothioate
  modified_base 23: mod_base = OTHER; note = 2'-O-methyluridine
ttatagagcaagaacactgtttt

SEQ ID NO: 436 - RNA, 23 nt, synthetic construct
  source 1..23: mol_type = other RNA
  modified_base 1: mod_base = OTHER; note = 2'-O-methyluridine-3'-phosphorothioate
  modified_base 2: mod_base = OTHER; note = 2'-deoxy-2'-fluorouridine-3'-phosphorothioate
  modified_base 3: mod_base = OTHER; note = 2'-O-methyladenosine-3'-phosphate
  modified_base 4: mod_base = OTHER; note = 2'-deoxy-2'-fluorouridine-3'-phosphate
  modified_base 5: mod_base = OTHER; note = 2'-O-methyladenosine-3'-phosphate
  modified_base 6: mod_base = OTHER; note = 2'-deoxy-2'-fluoroguanosine-3'-phosphate
  modified_base 7: mod_base = OTHER; note = Adenosine-glycol nucleic acid (GNA), S-isomer
  modified_base 8: mod_base = OTHER; note = 2'-deoxy-2'-fluoroguanosine-3'-phosphate
  modified_base 9: mod_base = OTHER; note = 2'-O-methylcytidine-3'-phosphate
  modified_base 10: mod_base = OTHER; note = 2'-deoxy-2'-fluoroadenosine-3'-phosphate
  modified_base 11: mod_base = OTHER; note = 2'-O-methyladenosine-3'-phosphate
  modified_base 12: mod_base = OTHER; note = 2'-O-methylguanosine-3'-phosphate
  modified_base 13: mod_base = OTHER; note = 2'-O-methyladenosine-3'-phosphate
  modified_base 14: mod_base = OTHER; note = 2'-deoxy-2'-fluoroadenosine-3'-phosphate
  modified_base 15: mod_base = OTHER; note = 2'-O-methylcytidine-3'-phosphate
  modified_base 16: mod_base = OTHER; note = 2'-deoxy-2'-fluoroadenosine-3'-phosphate
  modified_base 17: mod_base = OTHER; note = 2'-O-methylcytidine-3'-phosphate
  modified_base 18: mod_base = OTHER; note = 2'-deoxy-2'-fluorouridine-3'-phosphate
  modified_base 19: mod_base = OTHER; note = 2'-O-methylguanosine-3'-phosphate
  modified_base 20: mod_base = OTHER; note = 2'-deoxy-2'-fluorouridine-3'-phosphate
  modified_base 21: mod_base = OTHER; note = 2'-O-methyluridine-3'-phosphorothioate
  modified_base 22: mod_base = OTHER; note = 2'-O-methyluridine-3'-phosphorothioate
  modified_base 23: mod_base = OTHER; note = 2'-O-methyluridine
ttatagagcaagaacactgtttt

SEQ ID NO: 437 - RNA, 23 nt, synthetic construct
  source 1..23: mol_type = other RNA
  modified_base 1: mod_base = OTHER; note = 2'-O-methyluridine-3'-phosphorothioate
  modified_base 2: mod_base = OTHER; note = 2'-deoxy-2'-fluorouridine-3'-phosphorothioate
  modified_base 3: mod_base = OTHER; note = 2'-O-methyladenosine-3'-phosphate
  modified_base 4: mod_base = OTHER; note = 2'-deoxy-2'-fluorouridine-3'-phosphate
  modified_base 5: mod_base = OTHER; note = 2'-O-methyladenosine-3'-phosphate
  modified_base 6: mod_base = OTHER; note = 2'-deoxy-2'-fluoroguanosine-3'-phosphate
  modified_base 7: mod_base = OTHER; note = Adenosine-glycol nucleic acid (GNA), S-isomer
  modified_base 8: mod_base = OTHER; note = 2'-deoxy-2'-fluoroguanosine-3'-phosphate
  modified_base 9: mod_base = OTHER; note = 2'-O-methylcytidine-3'-phosphate
  modified_base 10: mod_base = OTHER; note = 2'-deoxy-2'-fluoroadenosine-3'-phosphate
  modified_base 11: mod_base = OTHER; note = 2'-O-methyladenosine-3'-phosphate
  modified_base 12: mod_base = OTHER; note = 2'-O-methylguanosine-3'-phosphate
  modified_base 13: mod_base = OTHER; note = 2'-O-methyladenosine-3'-phosphate
  modified_base 14: mod_base = OTHER; note = 2'-deoxy-2'-fluoroadenosine-3'-phosphate
  modified_base 15: mod_base = OTHER; note = 2'-O-methylcytidine-3'-phosphate
  modified_base 16: mod_base = OTHER; note = 2'-deoxy-2'-fluoroadenosine-3'-phosphate
  modified_base 17: mod_base = OTHER; note = 2'-O-methylcytidine-3'-phosphate
  modified_base 18: mod_base = OTHER; note = 2'-deoxy-2'-fluorouridine-3'-phosphate
  modified_base 19: mod_base = OTHER; note = 2'-O-methylguanosine-3'-phosphate
  modified_base 20: mod_base = OTHER; note = 2'-deoxy-2'-fluorouridine-3'-phosphate
  modified_base 21: mod_base = OTHER; note = 2'-O-methyluridine-3'-phosphorothioate
  modified_base 22: mod_base = OTHER; note = 2'-O-methyluridine-3'-phosphorothioate
  modified_base 23: mod_base = OTHER; note = 2'-O-methyluridine
ttatagagcaagaacactgtttt

SEQ ID NO: 438 - RNA, 23 nt, synthetic construct
  source 1..23: mol_type = other RNA
  modified_base 1: mod_base = OTHER; note = 2'-O-methyluridine-3'-phosphorothioate
  modified_base 2: mod_base = OTHER; note = 2'-deoxy-2'-fluorouridine-3'-phosphorothioate
  modified_base 3: mod_base = OTHER; note = Adenosine-glycol nucleic acid (GNA), S-isomer
  modified_base 4: mod_base = OTHER; note = 2'-deoxy-2'-fluorouridine-3'-phosphate
  modified_base 5: mod_base = OTHER; note = 2'-O-methyladenosine-3'-phosphate
  modified_base 6: mod_base = OTHER; note = 2'-deoxy-2'-fluoroguanosine-3'-phosphate
  modified_base 7: mod_base = OTHER; note = 2'-O-methyladenosine-3'-phosphate
  modified_base 8: mod_base = OTHER; note = 2'-deoxy-2'-fluoroguanosine-3'-phosphate
  modified_base 9: mod_base = OTHER; note = 2'-O-methylcytidine-3'-phosphate
  modified_base 10: mod_base = OTHER; note = 2'-deoxy-2'-fluoroadenosine-3'-phosphate
  modified_base 11: mod_base = OTHER; note = 2'-O-methyladenosine-3'-phosphate
  modified_base 12: mod_base = OTHER; note = 2'-O-methylguanosine-3'-phosphate
  modified_base 13: mod_base = OTHER; note = 2'-O-methyladenosine-3'-phosphate
  modified_base 14: mod_base = OTHER; note = 2'-deoxy-2'-fluoroadenosine-3'-phosphate
  modified_base 15: mod_base = OTHER; note = 2'-O-methylcytidine-3'-phosphate
  modified_base 16: mod_base = OTHER; note = 2'-deoxy-2'-fluoroadenosine-3'-phosphate
  modified_base 17: mod_base = OTHER; note = 2'-O-methylcytidine-3'-phosphate
  modified_base 18: mod_base = OTHER; note = 2'-deoxy-2'-fluorouridine-3'-phosphate
  modified_base 19: mod_base = OTHER; note = 2'-O-methylguanosine-3'-phosphate
  modified_base 20: mod_base = OTHER; note = 2'-deoxy-2'-fluorouridine-3'-phosphate
  modified_base 21: mod_base = OTHER; note = 2'-O-methyluridine-3'-phosphorothioate
  modified_base 22: mod_base = OTHER; note = 2'-O-methyluridine-3'-phosphorothioate
  modified_base 23: mod_base = OTHER; note = 2'-O-methyluridine
ttatagagcaagaacactgtttt

SEQ ID NO: 439 - RNA, 23 nt, synthetic construct
  source 1..23: mol_type = other RNA
  modified_base 1: mod_base = OTHER; note = 2'-O-methyluridine-3'-phosphorothioate
  modified_base 2: mod_base = OTHER; note = 2'-deoxy-2'-fluorouridine-3'-phosphorothioate
  modified_base 3: mod_base = OTHER; note = Adenosine-glycol nucleic acid (GNA), S-isomer
  modified_base 4: mod_base = OTHER; note = 2'-deoxy-2'-fluorouridine-3'-phosphate
  modified_base 5: mod_base = OTHER; note = 2'-O-methyladenosine-3'-phosphate
  modified_base 6: mod_base = OTHER; note = 2'-deoxy-2'-fluoroguanosine-3'-phosphate
  modified_base 7: mod_base = OTHER; note = 2'-O-methyladenosine-3'-phosphate
  modified_base 8: mod_base = OTHER; note = 2'-deoxy-2'-fluoroguanosine-3'-phosphate
  modified_base 9: mod_base = OTHER; note = 2'-O-methylcytidine-3'-phosphate
  modified_base 10: mod_base = OTHER; note = 2'-deoxy-2'-fluoroadenosine-3'-phosphate
  modified_base 11: mod_base = OTHER; note = 2'-O-methyladenosine-3'-phosphate
  modified_base 12: mod_base = OTHER; note = 2'-O-methylguanosine-3'-phosphate
  modified_base 13: mod_base = OTHER; note = 2'-O-methyladenosine-3'-phosphate
  modified_base 14: mod_base = OTHER; note = 2'-deoxy-2'-fluoroadenosine-3'-phosphate
  modified_base 15: mod_base = OTHER; note = 2'-O-methylcytidine-3'-phosphate
  modified_base 16: mod_base = OTHER; note = 2'-deoxy-2'-fluoroadenosine-3'-phosphate
  modified_base 17: mod_base = OTHER; note = 2'-O-methylcytidine-3'-phosphate
  modified_base 18: mod_base = OTHER; note = 2'-deoxy-2'-fluorouridine-3'-phosphate
  modified_base 19: mod_base = OTHER; note = 2'-O-methylguanosine-3'-phosphate
  modified_base 20: mod_base = OTHER; note = 2'-deoxy-2'-fluorouridine-3'-phosphate
  modified_base 21: mod_base = OTHER; note = 2'-O-methyluridine-3'-phosphorothioate
  modified_base 22: mod_base = OTHER; note = 2'-O-methyluridine-3'-phosphorothioate
  modified_base 23: mod_base = OTHER; note = 2'-O-methyluridine
ttatagagcaagaacactgtttt

SEQ ID NO: 440 - RNA, 23 nt, synthetic construct
  source 1..23: mol_type = other RNA
  modified_base 1: mod_base = OTHER; note = 2'-O-methyluridine-3'-phosphorothioate
  modified_base 2: mod_base = OTHER; note = 2'-deoxy-2'-fluorouridine-3'-phosphorothioate
  modified_base 3: mod_base = OTHER; note = Adenosine-glycol nucleic acid (GNA), S-isomer
  modified_base 4: mod_base = OTHER; note = 2'-deoxy-2'-fluorouridine-3'-phosphate
  modified_base 5: mod_base = OTHER; note = 2'-O-methyladenosine-3'-phosphate
  modified_base 6: mod_base = OTHER; note = 2'-deoxy-2'-fluoroguanosine-3'-phosphate
  modified_base 7: mod_base = OTHER; note = 2'-O-methyladenosine-3'-phosphate
  modified_base 8: mod_base = OTHER; note = 2'-deoxy-2'-fluoroguanosine-3'-phosphate
  modified_base 9: mod_base = OTHER; note = 2'-O-methylcytidine-3'-phosphate
  modified_base 10: mod_base = OTHER; note = 2'-deoxy-2'-fluoroadenosine-3'-phosphate
  modified_base 11: mod_base = OTHER; note = 2'-O-methyladenosine-3'-phosphate
  modified_base 12: mod_base = OTHER; note = 2'-O-methylguanosine-3'-phosphate
  modified_base 13: mod_base = OTHER; note = 2'-O-methyladenosine-3'-phosphate
  modified_base 14: mod_base = OTHER; note = 2'-deoxy-2'-fluoroadenosine-3'-phosphate
  modified_base 15: mod_base = OTHER; note = 2'-O-methylcytidine-3'-phosphate
  modified_base 16: mod_base = OTHER; note = 2'-deoxy-2'-fluoroadenosine-3'-phosphate
  modified_base 17: mod_base = OTHER; note = 2'-O-methylcytidine-3'-phosphate
  modified_base 18: mod_base = OTHER; note = 2'-deoxy-2'-fluorouridine-3'-phosphate
  modified_base 19: mod_base = OTHER; note = 2'-O-methylguanosine-3'-phosphate
  modified_base 20: mod_base = OTHER; note = 2'-deoxy-2'-fluorouridine-3'-phosphate
  modified_base 21: mod_base = OTHER; note = 2'-O-methyluridine-3'-phosphorothioate
  modified_base 22: mod_base = OTHER; note = 2'-O-methyluridine-3'-phosphorothioate
  modified_base 23: mod_base = OTHER; note = 2'-O-methyluridine
ttatagagcaagaacactgtttt

SEQ ID NO: 441 - RNA, 23 nt, synthetic construct
  source 1..23: mol_type = other RNA
  modified_base 1: mod_base = OTHER; note = 2'-O-methyluridine-3'-phosphorothioate
  modified_base 2: mod_base = OTHER; note = 2'-deoxy-2'-fluorouridine-3'-phosphorothioate
  modified_base 3: mod_base = OTHER; note = 2'-O-methyladenosine-3'-phosphate
  modified_base 4: mod_base = OTHER; note = 2'-deoxy-2'-fluorouridine-3'-phosphate
  modified_base 5: mod_base = OTHER; note = 2'-O-methyladenosine-3'-phosphate
  modified_base 6: mod_base = OTHER; note = 2'-deoxy-2'-fluoroguanosine-3'-phosphate
  modified_base 7: mod_base = OTHER; note = 2'-O-methyladenosine-3'-phosphate
  modified_base 8: mod_base = OTHER; note = Guanosine-glycol nucleic acid (GNA), S-isomer
  modified_base 9: mod_base = OTHER; note = 2'-O-methylcytidine-3'-phosphate
  modified_base 10: mod_base = OTHER; note = 2'-deoxy-2'-fluoroadenosine-3'-phosphate
  modified_base 11: mod_base = OTHER; note = 2'-O-methyladenosine-3'-phosphate
  modified_base 12: mod_base = OTHER; note = 2'-O-methylguanosine-3'-phosphate
  modified_base 13: mod_base = OTHER; note = 2'-O-methyladenosine-3'-phosphate
  modified_base 14: mod_base = OTHER; note = 2'-deoxy-2'-fluoroadenosine-3'-phosphate
  modified_base 15: mod_base = OTHER; note = 2'-O-methylcytidine-3'-phosphate
  modified_base 16: mod_base = OTHER; note = 2'-deoxy-2'-fluoroadenosine-3'-phosphate
  modified_base 17: mod_base = OTHER; note = 2'-O-methylcytidine-3'-phosphate
  modified_base 18: mod_base = OTHER; note = 2'-deoxy-2'-fluorouridine-3'-phosphate
  modified_base 19: mod_base = OTHER; note = 2'-O-methylguanosine-3'-phosphate
  modified_base 20: mod_base = OTHER; note = 2'-deoxy-2'-fluorouridine-3'-phosphate
  modified_base 21: mod_base = OTHER; note = 2'-O-methyluridine-3'-phosphorothioate
  modified_base 22: mod_base = OTHER; note = 2'-O-methyluridine-3'-phosphorothioate
  modified_base 23: mod_base = OTHER; note = 2'-O-methyluridine
ttatagagcaagaacactgtttt

SEQ ID NO: 442 - RNA, 23 nt, synthetic construct
  source 1..23: mol_type = other RNA
  modified_base 1: mod_base = OTHER; note = 2'-O-methyluridine-3'-phosphorothioate
  modified_base 2: mod_base = OTHER; note = 2'-deoxy-2'-fluorouridine-3'-phosphorothioate
  modified_base 3: mod_base = OTHER; note = 2'-O-methyladenosine-3'-phosphate
  modified_base 4: mod_base = OTHER; note = 2'-deoxy-2'-fluorouridine-3'-phosphate
  modified_base 5: mod_base = OTHER; note = 2'-O-methyladenosine-3'-phosphate
  modified_base 6: mod_base = OTHER; note = 2'-deoxy-2'-fluoroguanosine-3'-phosphate
  modified_base 7: mod_base = OTHER; note = 2'-O-methyladenosine-3'-phosphate
  modified_base 8: mod_base = OTHER; note = Guanosine-glycol nucleic acid (GNA), S-isomer
  modified_base 9: mod_base = OTHER; note = 2'-O-methylcytidine-3'-phosphate
  modified_base 10: mod_base = OTHER; note = 2'-deoxy-2'-fluoroadenosine-3'-phosphate
  modified_base 11: mod_base = OTHER; note = 2'-O-methyladenosine-3'-phosphate
  modified_base 12: mod_base = OTHER; note = 2'-O-methylguanosine-3'-phosphate
  modified_base 13: mod_base = OTHER; note = 2'-O-methyladenosine-3'-phosphate
  modified_base 14: mod_base = OTHER; note = 2'-deoxy-2'-fluoroadenosine-3'-phosphate
  modified_base 15: mod_base = OTHER; note = 2'-O-methylcytidine-3'-phosphate
  modified_base 16: mod_base = OTHER; note = 2'-deoxy-2'-fluoroadenosine-3'-phosphate
  modified_base 17: mod_base = OTHER; note = 2'-O-methylcytidine-3'-phosphate
  modified_base 18: mod_base = OTHER; note = 2'-deoxy-2'-fluorouridine-3'-phosphate
  modified_base 19: mod_base = OTHER; note = 2'-O-methylguanosine-3'-phosphate
  modified_base 20: mod_base = OTHER; note = 2'-deoxy-2'-fluorouridine-3'-phosphate
  modified_base 21: mod_base = OTHER; note = 2'-O-methyluridine-3'-phosphorothioate
  modified_base 22: mod_base = OTHER; note = 2'-O-methyluridine-3'-phosphorothioate
  modified_base 23: mod_base = OTHER; note = 2'-O-methyluridine
ttatagagcaagaacactgtttt

SEQ ID NO: 443 - RNA, 23 nt, synthetic construct
  source 1..23: mol_type = other RNA
  modified_base 1: mod_base = OTHER; note = 2'-O-methyluridine-3'-phosphorothioate
  modified_base 2: mod_base = OTHER; note = 2'-deoxy-2'-fluorouridine-3'-phosphorothioate
  modified_base 3: mod_base = OTHER; note = 2'-O-methyladenosine-3'-phosphate
  modified_base 4: mod_base = OTHER; note = 2'-deoxy-2'-fluorouridine-3'-phosphate
  modified_base 5: mod_base = OTHER; note = 2'-O-methyladenosine-3'-phosphate
  modified_base 6: mod_base = OTHER; note = 2'-deoxy-2'-fluoroguanosine-3'-phosphate
  modified_base 7: mod_base = OTHER; note = 2'-O-methyladenosine-3'-phosphate
  modified_base 8: mod_base = OTHER; note = Guanosine-glycol nucleic acid (GNA), S-isomer
  modified_base 9: mod_base = OTHER; note = 2'-O-methylcytidine-3'-phosphate
  modified_base 10: mod_base = OTHER; note = 2'-deoxy-2'-fluoroadenosine-3'-phosphate
  modified_base 11: mod_base = OTHER; note = 2'-O-methyladenosine-3'-phosphate
  modified_base 12: mod_base = OTHER; note = 2'-O-methylguanosine-3'-phosphate
  modified_base 13: mod_base = OTHER; note = 2'-O-methyladenosine-3'-phosphate
  modified_base 14: mod_base = OTHER; note = 2'-deoxy-2'-fluoroadenosine-3'-phosphate
  modified_base 15: mod_base = OTHER; note = 2'-O-methylcytidine-3'-phosphate
  modified_base 16: mod_base = OTHER; note = 2'-deoxy-2'-fluoroadenosine-3'-phosphate
  modified_base 17: mod_base = OTHER; note = 2'-O-methylcytidine-3'-phosphate
  modified_base 18: mod_base = OTHER; note = 2'-deoxy-2'-fluorouridine-3'-phosphate
  modified_base 19: mod_base = OTHER; note = 2'-O-methylguanosine-3'-phosphate
  modified_base 20: mod_base = OTHER; note = 2'-deoxy-2'-fluorouridine-3'-phosphate
  modified_base 21: mod_base = OTHER; note = 2'-O-methyluridine-3'-phosphorothioate
  modified_base 22: mod_base = OTHER; note = 2'-O-methyluridine-3'-phosphorothioate
  modified_base 23: mod_base = OTHER; note = 2'-O-methyluridine
ttatagagcaagaacactgtttt

SEQ ID NO: 444 - RNA, 23 nt, synthetic construct
  source 1..23: mol_type = other RNA
  modified_base 1: mod_base = OTHER; note = 2'-O-methyluridine-3'-phosphorothioate
  modified_base 2: mod_base = OTHER; note = 2'-deoxy-2'-fluorouridine-3'-phosphorothioate
  modified_base 3: mod_base = OTHER; note = 2'-O-methyladenosine-3'-phosphate
  modified_base 4: mod_base = OTHER; note = 2'-deoxy-2'-fluorouridine-3'-phosphate
  modified_base 5: mod_base = OTHER; note = 2'-O-methyladenosine-3'-phosphate
  modified_base 6: mod_base = OTHER; note = Guanosine-glycol nucleic acid (GNA), S-isomer
  modified_base 7: mod_base = OTHER; note = 2'-O-methyladenosine-3'-phosphate
  modified_base 8: mod_base = OTHER; note = 2'-deoxy-2'-fluoroguanosine-3'-phosphate
  modified_base 9: mod_base = OTHER; note = 2'-O-methylcytidine-3'-phosphate
  modified_base 10: mod_base = OTHER; note = 2'-deoxy-2'-fluoroadenosine-3'-phosphate
  modified_base 11: mod_base = OTHER; note = 2'-O-methyladenosine-3'-phosphate
  modified_base 12: mod_base = OTHER; note = 2'-O-methylguanosine-3'-phosphate
  modified_base 13: mod_base = OTHER; note = 2'-O-methyladenosine-3'-phosphate
  modified_base 14: mod_base = OTHER; note = 2'-deoxy-2'-fluoroadenosine-3'-phosphate
  modified_base 15: mod_base = OTHER; note = 2'-O-methylcytidine-3'-phosphate
  modified_base 16: mod_base = OTHER; note = 2'-deoxy-2'-fluoroadenosine-3'-phosphate
  modified_base 17: mod_base = OTHER; note = 2'-O-methylcytidine-3'-phosphate
  modified_base 18: mod_base = OTHER; note = 2'-deoxy-2'-fluorouridine-3'-phosphate
  modified_base 19: mod_base = OTHER; note = 2'-O-methylguanosine-3'-phosphate
  modified_base 20: mod_base = OTHER; note = 2'-deoxy-2'-fluorouridine-3'-phosphate
  modified_base 21: mod_base = OTHER; note = 2'-O-methyluridine-3'-phosphorothioate
  modified_base 22: mod_base = OTHER; note = 2'-O-methyluridine-3'-phosphorothioate
  modified_base 23: mod_base = OTHER; note = 2'-O-methyluridine
ttatagagcaagaacactgtttt

SEQ ID NO: 445 - RNA, 23 nt, synthetic construct
  source 1..23: mol_type = other RNA
  modified_base 1: mod_base = OTHER; note = 2'-O-methyluridine-3'-phosphorothioate
  modified_base 2: mod_base = OTHER; note = 2'-deoxy-2'-fluorouridine-3'-phosphorothioate
  modified_base 3: mod_base = OTHER; note = 2'-O-methyladenosine-3'-phosphate
  modified_base 4: mod_base = OTHER; note = 2'-deoxy-2'-fluorouridine-3'-phosphate
  modified_base 5: mod_base = OTHER; note = 2'-O-methyladenosine-3'-phosphate
  modified_base 6: mod_base = OTHER; note = 2'-deoxy-2'-fluoroguanosine-3'-phosphate
  modified_base 7: mod_base = OTHER; note = Adenosine-glycol nucleic acid (GNA), S-isomer
  modified_base 8: mod_base = OTHER; note = 2'-deoxy-2'-fluoroguanosine-3'-phosphate
  modified_base 9: mod_base = OTHER; note = 2'-O-methylcytidine-3'-phosphate
  modified_base 10: mod_base = OTHER; note = 2'-deoxy-2'-fluoroadenosine-3'-phosphate
  modified_base 11: mod_base = OTHER; note = 2'-O-methyladenosine-3'-phosphate
  modified_base 12: mod_base = OTHER; note = 2'-O-methylguanosine-3'-phosphate
  modified_base 13: mod_base = OTHER; note = 2'-O-methyladenosine-3'-phosphate
  modified_base 14: mod_base = OTHER; note = 2'-deoxy-2'-fluoroadenosine-3'-phosphate
  modified_base 15: mod_base = OTHER; note = 2'-O-methylcytidine-3'-phosphate
  modified_base 16: mod_base = OTHER; note = 2'-deoxy-2'-fluoroadenosine-3'-phosphate
  modified_base 17: mod_base = OTHER; note = 2'-O-methylcytidine-3'-phosphate
  modified_base 18: mod_base = OTHER; note = 2'-deoxy-2'-fluorouridine-3'-phosphate
  modified_base 19: mod_base = OTHER; note = 2'-O-methylguanosine-3'-phosphate
  modified_base 20: mod_base = OTHER; note = 2'-deoxy-2'-fluorouridine-3'-phosphate
  modified_base 21: mod_base = OTHER; note = 2'-O-methyluridine-3'-phosphorothioate
  modified_base 22: mod_base = OTHER; note = 2'-O-methyluridine-3'-phosphorothioate
  modified_base 23: mod_base = OTHER; note = 2'-O-methyluridine
ttatagagcaagaacactgtttt

SEQ ID NO: 446 - RNA, 23 nt, synthetic construct
  source 1..23: mol_type = other RNA
  modified_base 1: mod_base = OTHER; note = 2'-O-methyluridine-3'-phosphorothioate
  modified_base 2: mod_base = OTHER; note = 2'-deoxy-2'-fluorouridine-3'-phosphorothioate
  modified_base 3: mod_base = OTHER; note = 2'-O-methyladenosine-3'-phosphate
  modified_base 4: mod_base = OTHER; note = 2'-deoxy-2'-fluorouridine-3'-phosphate
  modified_base 5: mod_base = OTHER; note = 2'-O-methyladenosine-3'-phosphate
  modified_base 6: mod_base = OTHER; note = Guanosine-glycol nucleic acid (GNA), S-isomer
  modified_base 7: mod_base = OTHER; note = 2'-O-methyladenosine-3'-phosphate
  modified_base 8: mod_base = OTHER; note = 2'-deoxy-2'-fluoroguanosine-3'-phosphate
  modified_base 9: mod_base = OTHER; note = 2'-O-methylcytidine-3'-phosphate
  modified_base 10: mod_base = OTHER; note = 2'-deoxy-2'-fluoroadenosine-3'-phosphate
  modified_base 11: mod_base = OTHER; note = 2'-O-methyladenosine-3'-phosphate
  modified_base 12: mod_base = OTHER; note = 2'-O-methylguanosine-3'-phosphate
  modified_base 13: mod_base = OTHER; note = 2'-O-methyladenosine-3'-phosphate
  modified_base 14: mod_base = OTHER; note = 2'-deoxy-2'-fluoroadenosine-3'-phosphate
  modified_base 15: mod_base = OTHER; note = 2'-O-methylcytidine-3'-phosphate
  modified_base 16: mod_base = OTHER; note = 2'-deoxy-2'-fluoroadenosine-3'-phosphate
  modified_base 17: mod_base = OTHER; note = 2'-O-methylcytidine-3'-phosphate
  modified_base 18: mod_base = OTHER; note = 2'-deoxy-2'-fluorouridine-3'-phosphate
  modified_base 19: mod_base = OTHER; note = 2'-O-methylguanosine-3'-phosphate
  modified_base 20: mod_base = OTHER; note = 2'-deoxy-2'-fluorouridine-3'-phosphate
  modified_base 21: mod_base = OTHER; note = 2'-O-methyluridine-3'-phosphorothioate
  modified_base 22: mod_base = OTHER; note = 2'-O-methyluridine-3'-phosphorothioate
  modified_base 23: mod_base = OTHER; note = 2'-O-methyluridine
ttatagagcaagaacactgtttt

SEQ ID NO: 447 - RNA, 23 nt, synthetic construct
  source 1..23: mol_type = other RNA
  modified_base 1: mod_base = OTHER; note = 2'-O-methyluridine-3'-phosphorothioate
  modified_base 2: mod_base = OTHER; note = 2'-deoxy-2'-fluorouridine-3'-phosphorothioate
  modified_base 3: mod_base = OTHER; note = 2'-O-methyladenosine-3'-phosphate
  modified_base 4: mod_base = OTHER; note = 2'-deoxy-2'-fluorouridine-3'-phosphate
  modified_base 5: mod_base = OTHER; note = 2'-O-methyladenosine-3'-phosphate
  modified_base 6: mod_base = OTHER; note = 2'-deoxy-2'-fluoroguanosine-3'-phosphate
  modified_base 7: mod_base = OTHER; note = Adenosine-glycol nucleic acid (GNA), S-isomer
  modified_base 8: mod_base = OTHER; note = 2'-deoxy-2'-fluoroguanosine-3'-phosphate
  modified_base 9: mod_base = OTHER; note = 2'-O-methylcytidine-3'-phosphate
  modified_base 10: mod_base = OTHER; note = 2'-deoxy-2'-fluoroadenosine-3'-phosphate
  modified_base 11: mod_base = OTHER; note = 2'-O-methyladenosine-3'-phosphate
  modified_base 12: mod_base = OTHER; note = 2'-O-methylguanosine-3'-phosphate
  modified_base 13: mod_base = OTHER; note = 2'-O-methyladenosine-3'-phosphate
  modified_base 14: mod_base = OTHER; note = 2'-deoxy-2'-fluoroadenosine-3'-phosphate
  modified_base 15: mod_base = OTHER; note = 2'-O-methylcytidine-3'-phosphate
  modified_base 16: mod_base = OTHER; note = 2'-deoxy-2'-fluoroadenosine-3'-phosphate
  modified_base 17: mod_base = OTHER; note = 2'-O-methylcytidine-3'-phosphate
  modified_base 18: mod_base = OTHER; note = 2'-deoxy-2'-fluorouridine-3'-phosphate
  modified_base 19: mod_base = OTHER; note = 2'-O-methylguanosine-3'-phosphate
  modified_base 20: mod_base = OTHER; note = 2'-deoxy-2'-fluorouridine-3'-phosphate
  modified_base 21: mod_base = OTHER; note = 2'-O-methyluridine-3'-phosphorothioate
  modified_base 22: mod_base = OTHER; note = 2'-O-methyluridine-3'-phosphorothioate
  modified_base 23: mod_base = OTHER; note = 2'-O-methyluridine
ttatagagcaagaacactgtttt

SEQ ID NO: 448 - RNA, 23 nt, synthetic construct
  source 1..23: mol_type = other RNA
  modified_base 1: mod_base = OTHER; note = 2'-O-methyluridine-3'-phosphorothioate
  modified_base 2: mod_base = OTHER; note = 2'-deoxy-2'-fluorouridine-3'-phosphorothioate
  modified_base 3: mod_base = OTHER; note = 2'-O-methyladenosine-3'-phosphate
  modified_base 4: mod_base = OTHER; note = 2'-deoxy-2'-fluorouridine-3'-phosphate
  modified_base 5: mod_base = OTHER; note = 2'-O-methyladenosine-3'-phosphate
  modified_base 6: mod_base = OTHER; note = Guanosine-glycol nucleic acid (GNA), S-isomer
  modified_base 7: mod_base = OTHER; note = 2'-O-methyladenosine-3'-phosphate
  modified_base 8: mod_base = OTHER; note = 2'-deoxy-2'-fluoroguanosine-3'-phosphate
  modified_base 9: mod_base = OTHER; note = 2'-O-methylcytidine-3'-phosphate
  modified_base 10: mod_base = OTHER; note = 2'-deoxy-2'-fluoroadenosine-3'-phosphate
  modified_base 11: mod_base = OTHER; note = 2'-O-methyladenosine-3'-phosphate
  modified_base 12: mod_base = OTHER; note = 2'-O-methylguanosine-3'-phosphate
  modified_base 13: mod_base = OTHER; note = 2'-O-methyladenosine-3'-phosphate
  modified_base 14: mod_base = OTHER; note = 2'-deoxy-2'-fluoroadenosine-3'-phosphate
  modified_base 15: mod_base = OTHER; note = 2'-O-methylcytidine-3'-phosphate
  modified_base 16: mod_base = OTHER; note = 2'-deoxy-2'-fluoroadenosine-3'-phosphate
  modified_base 17: mod_base = OTHER; note = 2'-O-methylcytidine-3'-phosphate
  modified_base 18: mod_base = OTHER; note = 2'-deoxy-2'-fluorouridine-3'-phosphate
  modified_base 19: mod_base = OTHER; note = 2'-O-methylguanosine-3'-phosphate
  modified_base 20: mod_base = OTHER; note = 2'-deoxy-2'-fluorouridine-3'-phosphate
  modified_base 21: mod_base = OTHER; note = 2'-O-methyluridine-3'-phosphorothioate
  modified_base 22: mod_base = OTHER; note = 2'-O-methyluridine-3'-phosphorothioate
  modified_base 23: mod_base = OTHER; note = 2'-O-methyluridine
ttatagagcaagaacactgtttt

SEQ ID NO: 449 - RNA, 23 nt, synthetic construct
  source 1..23: mol_type = other RNA
  modified_base 1: mod_base = OTHER; note = 2'-O-methyluridine-3'-phosphorothioate
  modified_base 2: mod_base = OTHER; note = 2'-deoxy-2'-fluorouridine-3'-phosphorothioate
  modified_base 3: mod_base = OTHER; note = 2'-O-methyladenosine-3'-phosphate
  modified_base 4: mod_base = OTHER; note = 2'-deoxy-2'-fluorouridine-3'-phosphate
  modified_base 5: mod_base = OTHER; note = 2'-O-methyladenosine-3'-phosphate
  modified_base 6: mod_base = OTHER; note = 2'-deoxy-2'-fluoroguanosine-3'-phosphate
  modified_base 7: mod_base = OTHER; note = Adenosine-glycol nucleic acid (GNA), S-isomer
  modified_base 8: mod_base = OTHER; note = 2'-deoxy-2'-fluoroguanosine-3'-phosphate
  modified_base 9: mod_base = OTHER; note = 2'-O-methylcytidine-3'-phosphate
  modified_base 10: mod_base = OTHER; note = 2'-deoxy-2'-fluoroadenosine-3'-phosphate
  modified_base 11: mod_base = OTHER; note = 2'-O-methyladenosine-3'-phosphate
  modified_base 12: mod_base = OTHER; note = 2'-O-methylguanosine-3'-phosphate
  modified_base 13: mod_base = OTHER; note = 2'-O-methyladenosine-3'-phosphate
  modified_base 14: mod_base = OTHER; note = 2'-deoxy-2'-fluoroadenosine-3'-phosphate
  modified_base 15: mod_base = OTHER; note = 2'-O-methylcytidine-3'-phosphate
  modified_base 16: mod_base = OTHER; note = 2'-deoxy-2'-fluoroadenosine-3'-phosphate
  modified_base 17: mod_base = OTHER; note = 2'-O-methylcytidine-3'-phosphate
  modified_base 18: mod_base = OTHER; note = 2'-deoxy-2'-fluorouridine-3'-phosphate
  modified_base 19: mod_base = OTHER; note = 2'-O-methylguanosine-3'-phosphate
  modified_base 20: mod_base = OTHER; note = 2'-deoxy-2'-fluorouridine-3'-phosphate
  modified_base 21: mod_base = OTHER; note = 2'-O-methyluridine-3'-phosphorothioate
  modified_base 22: mod_base = OTHER; note = 2'-O-methyluridine-3'-phosphorothioate
  modified_base 23: mod_base = OTHER; note = 2'-O-methyluridine
ttatagagcaagaacactgtttt

SEQ ID NO: 450 - RNA, 23 nt, synthetic construct
  source 1..23: mol_type = other RNA
  modified_base 1: mod_base = OTHER; note = 2'-O-methyluridine-3'-phosphorothioate
  modified_base 2: mod_base = OTHER; note = 2'-deoxy-2'-fluorouridine-3'-phosphorothioate
  modified_base 3: mod_base = OTHER; note = 2'-O-methyladenosine-3'-phosphate
  modified_base 4: mod_base = OTHER; note = 2'-deoxy-2'-fluorouridine-3'-phosphate
  modified_base 5: mod_base = OTHER; note = 2'-O-methyladenosine-3'-phosphate
  modified_base 6: mod_base = OTHER; note = Guanosine-glycol nucleic acid (GNA), S-isomer
  modified_base 7: mod_base = OTHER; note = 2'-O-methyladenosine-3'-phosphate
  modified_base 8: mod_base = OTHER; note = 2'-deoxy-2'-fluoroguanosine-3'-phosphate
  modified_base 9: mod_base = OTHER; note = 2'-O-methylcytidine-3'-phosphate
  modified_base 10: mod_base = OTHER; note = 2'-deoxy-2'-fluoroadenosine-3'-phosphate
  modified_base 11: mod_base = OTHER; note = 2'-O-methyladenosine-3'-phosphate
  modified_base 12: mod_base = OTHER; note = 2'-O-methylguanosine-3'-phosphate
  modified_base 13: mod_base = OTHER; note = 2'-O-methyladenosine-3'-phosphate
  modified_base 14: mod_base = OTHER; note = 2'-deoxy-2'-fluoroadenosine-3'-phosphate
  modified_base 15: mod_base = OTHER; note = 2'-O-methylcytidine-3'-phosphate
  modified_base 16: mod_base = OTHER; note = 2'-deoxy-2'-fluoroadenosine-3'-phosphate
  modified_base 17: mod_base = OTHER; note = 2'-O-methylcytidine-3'-phosphate
  modified_base 18: mod_base = OTHER; note = 2'-deoxy-2'-fluorouridine-3'-phosphate
  modified_base 19: mod_base = OTHER; note = 2'-O-methylguanosine-3'-phosphate
  modified_base 20: mod_base = OTHER; note = 2'-deoxy-2'-fluorouridine-3'-phosphate
  modified_base 21: mod_base = OTHER; note = 2'-O-methyluridine-3'-phosphorothioate
  modified_base 22: mod_base = OTHER; note = 2'-O-methyluridine-3'-phosphorothioate
  modified_base 23: mod_base = OTHER; note = 2'-O-methyluridine
ttatagagcaagaacactgtttt

SEQ ID NO: 451 - RNA, 23 nt, synthetic construct
  source 1..23: mol_type = other RNA
  modified_base 1: mod_base = OTHER; note = 2'-O-methyluridine-3'-phosphorothioate
  modified_base 2: mod_base = OTHER; note = 2'-deoxy-2'-fluorouridine-3'-phosphorothioate
  modified_base 3: mod_base = OTHER; note = 2'-O-methyladenosine-3'-phosphate
  modified_base 4: mod_base = OTHER; note = 2'-deoxy-2'-fluorouridine-3'-phosphate
  modified_base 5: mod_base = OTHER; note = 2'-O-methyladenosine-3'-phosphate
  modified_base 6: mod_base = OTHER; note = 2'-deoxy-2'-fluoroguanosine-3'-phosphate
  modified_base 7: mod_base = OTHER; note = Adenosine-glycol nucleic acid (GNA), S-isomer
  modified_base 8: mod_base = OTHER; note = 2'-deoxy-2'-fluoroguanosine-3'-phosphate
  modified_base 9: mod_base = OTHER; note = 2'-O-methylcytidine-3'-phosphate
  modified_base 10: mod_base = OTHER; note = 2'-deoxy-2'-fluoroadenosine-3'-phosphate
  modified_base 11: mod_base = OTHER; note = 2'-O-methyladenosine-3'-phosphate
  modified_base 12: mod_base = OTHER; note = 2'-O-methylguanosine-3'-phosphate
  modified_base 13: mod_base = OTHER; note = 2'-O-methyladenosine-3'-phosphate
  modified_base 14: mod_base = OTHER; note = 2'-deoxy-2'-fluoroadenosine-3'-phosphate
  modified_base 15: mod_base = OTHER; note = 2'-O-methylcytidine-3'-phosphate
  modified_base 16: mod_base = OTHER; note = 2'-deoxy-2'-fluoroadenosine-3'-phosphate
  modified_base 17: mod_base = OTHER; note = 2'-O-methylcytidine-3'-phosphate
  modified_base 18: mod_base = OTHER; note = 2'-deoxy-2'-fluorouridine-3'-phosphate
  modified_base 19: mod_base = OTHER; note = 2'-O-methylguanosine-3'-phosphate
  modified_base 20: mod_base = OTHER; note = 2'-deoxy-2'-fluorouridine-3'-phosphate
  modified_base 21: mod_base = OTHER; note = 2'-O-methyluridine-3'-phosphorothioate
  modified_base 22: mod_base = OTHER; note = 2'-O-methyluridine-3'-phosphorothioate
  modified_base 23: mod_base = OTHER; note = 2'-O-methyluridine
ttatagagcaagaacactgtttt

SEQ ID NO: 452 - RNA, 23 nt, synthetic construct
  source 1..23: mol_type = other RNA
  modified_base 1: mod_base = OTHER; note = 2'-O-methyluridine-3'-phosphorothioate
  modified_base 2: mod_base = OTHER; note = Thymidine-glycol nucleic acid (GNA), S-Isomer phosphorothioate
  modified_base 3: mod_base = OTHER; note = 2'-O-methyladenosine-3'-phosphate
  modified_base 4: mod_base = OTHER; note = 2'-deoxy-2'-fluorouridine-3'-phosphate
  modified_base 5: mod_base = OTHER; note = 2'-O-methyladenosine-3'-phosphate
  modified_base 6: mod_base = OTHER; note = 2'-deoxy-2'-fluoroguanosine-3'-phosphate
  modified_base 7: mod_base = OTHER; note = 2'-O-methyladenosine-3'-phosphate
  modified_base 8: mod_base = OTHER; note = 2'-deoxy-2'-fluoroguanosine-3'-phosphate
  modified_base 9: mod_base = OTHER; note = 2'-O-methylcytidine-3'-phosphate
  modified_base 10: mod_base = OTHER; note = 2'-deoxy-2'-fluoroadenosine-3'-phosphate
  modified_base 11: mod_base = OTHER; note = 2'-O-methyladenosine-3'-phosphate
  modified_base 12: mod_base = OTHER; note = 2'-O-methylguanosine-3'-phosphate
  modified_base 13: mod_base = OTHER; note = 2'-O-methyladenosine-3'-phosphate
  modified_base 14: mod_base = OTHER; note = 2'-deoxy-2'-fluoroadenosine-3'-phosphate
  modified_base 15: mod_base = OTHER; note = 2'-O-methylcytidine-3'-phosphate
  modified_base 16: mod_base = OTHER; note = 2'-deoxy-2'-fluoroadenosine-3'-phosphate
  modified_base 17: mod_base = OTHER; note = 2'-O-methylcytidine-3'-phosphate
  modified_base 18: mod_base = OTHER; note = 2'-deoxy-2'-fluorouridine-3'-phosphate
  modified_base 19: mod_base = OTHER; note = 2'-O-methylguanosine-3'-phosphate
  modified_base 20: mod_base = OTHER; note = 2'-deoxy-2'-fluorouridine-3'-phosphate
  modified_base 21: mod_base = OTHER; note = 2'-O-methyluridine-3'-phosphorothioate
  modified_base 22: mod_base = OTHER; note = 2'-O-methyluridine-3'-phosphorothioate
  modified_base 23: mod_base = OTHER; note = 2'-O-methyluridine
ttatagagcaagaacactgtttt

SEQ ID NO: 453 - RNA, 23 nt, synthetic construct
  source 1..23: mol_type = other RNA
  modified_base 1: mod_base = OTHER; note = 2'-O-methyluridine-3'-phosphorothioate
  modified_base 2: mod_base = OTHER; note = Thymidine-glycol nucleic acid (GNA), S-Isomer phosphorothioate
  modified_base 3: mod_base = OTHER; note = 2'-O-methyladenosine-3'-phosphate
  modified_base 4: mod_base = OTHER; note = 2'-deoxy-2'-fluorouridine-3'-phosphate
  modified_base 5: mod_base = OTHER; note = 2'-O-methyladenosine-3'-phosphate
  modified_base 6: mod_base = OTHER; note = 2'-deoxy-2'-fluoroguanosine-3'-phosphate
  modified_base 7: mod_base = OTHER; note = 2'-O-methyladenosine-3'-phosphate
  modified_base 8: mod_base = OTHER; note = 2'-deoxy-2'-fluoroguanosine-3'-phosphate
  modified_base 9: mod_base = OTHER; note = 2'-O-methylcytidine-3'-phosphate
  modified_base 10: mod_base = OTHER; note = 2'-deoxy-2'-fluoroadenosine-3'-phosphate
  modified_base 11: mod_base = OTHER; note = 2'-O-methyladenosine-3'-phosphate
  modified_base 12: mod_base = OTHER; note = 2'-O-methylguanosine-3'-phosphate
  modified_base 13: mod_base = OTHER; note = 2'-O-methyladenosine-3'-phosphate
  modified_base 14: mod_base = OTHER; note = 2'-deoxy-2'-fluoroadenosine-3'-phosphate
  modified_base 15: mod_base = OTHER; note = 2'-O-methylcytidine-3'-phosphate
  modified_base 16: mod_base = OTHER; note = 2'-deoxy-2'-fluoroadenosine-3'-phosphate
  modified_base 17: mod_base = OTHER; note = 2'-O-methylcytidine-3'-phosphate
  modified_base 18: mod_base = OTHER; note = 2'-deoxy-2'-fluorouridine-3'-phosphate
  modified_base 19: mod_base = OTHER; note = 2'-O-methylguanosine-3'-phosphate
  modified_base 20: mod_base = OTHER; note = 2'-deoxy-2'-fluorouridine-3'-phosphate
  modified_base 21: mod_base = OTHER; note = 2'-O-methyluridine-3'-phosphorothioate
  modified_base 22: mod_base = OTHER; note = 2'-O-methyluridine-3'-phosphorothioate
  modified_base 23: mod_base = OTHER; note = 2'-O-methyluridine
ttatagagcaagaacactgtttt

SEQ ID NO: 454 - RNA, 23 nt, synthetic construct
  source 1..23: mol_type = other RNA
  modified_base 1: mod_base = OTHER; note = 2'-O-methyluridine-3'-phosphorothioate
  modified_base 2: mod_base = OTHER; note = 2'-deoxy-2'-fluorouridine-3'-phosphorothioate
  modified_base 3: mod_base = OTHER; note = 2'-O-methyladenosine-3'-phosphate
  modified_base 4: mod_base = OTHER; note = 2'-deoxy-2'-fluorouridine-3'-phosphate
  modified_base 5: mod_base = OTHER; note = 2'-O-methyladenosine-3'-phosphate
  modified_base 6: mod_base = OTHER; note = Guanosine-glycol nucleic acid (GNA), S-isomer
  modified_base 7: mod_base = OTHER; note = 2'-O-methyladenosine-3'-phosphate
  modified_base 8: mod_base = OTHER; note = 2'-deoxy-2'-fluoroguanosine-3'-phosphate
  modified_base 9: mod_base = OTHER; note = 2'-O-methylcytidine-3'-phosphate
  modified_base 10: mod_base = OTHER; note = 2'-deoxy-2'-fluoroadenosine-3'-phosphate
  modified_base 11: mod_base = OTHER; note = 2'-O-methyladenosine-3'-phosphate
  modified_base 12: mod_base = OTHER; note = 2'-O-methylguanosine-3'-phosphate
  modified_base 13: mod_base = OTHER; note = 2'-O-methyladenosine-3'-phosphate
  modified_base 14: mod_base = OTHER; note = 2'-deoxy-2'-fluoroadenosine-3'-phosphate
  modified_base 15: mod_base = OTHER; note = 2'-O-methylcytidine-3'-phosphate
  modified_base 16: mod_base = OTHER; note = 2'-deoxy-2'-fluoroadenosine-3'-phosphate
  modified_base 17: mod_base = OTHER; note = 2'-O-methylcytidine-3'-phosphate
  modified_base 18: mod_base = OTHER; note = 2'-deoxy-2'-fluorouridine-3'-phosphate
  modified_base 19: mod_base = OTHER; note = 2'-O-methylguanosine-3'-phosphate
  modified_base 20: mod_base = OTHER; note = 2'-deoxy-2'-fluorouridine-3'-phosphate
  modified_base 21: mod_base = OTHER; note = 2'-O-methyluridine-3'-phosphorothioate
  modified_base 22: mod_base = OTHER; note = 2'-O-methyluridine-3'-phosphorothioate
  modified_base 23: mod_base = OTHER; note = 2'-O-methyluridine
ttatagagcaagaacactgtttt

SEQ ID NO: 455 - RNA, 23 nt, synthetic construct
  source 1..23: mol_type = other RNA
  modified_base 1: mod_base = OTHER; note = 2'-O-methyluridine-3'-phosphorothioate
  modified_base 2: mod_base = OTHER; note = 2'-deoxy-2'-fluorouridine-3'-phosphorothioate
  modified_base 3: mod_base = OTHER; note = 2'-O-methyladenosine-3'-phosphate
  modified_base 4: mod_base = OTHER; note = 2'-deoxy-2'-fluorouridine-3'-phosphate
  modified_base 5: mod_base = OTHER; note = 2'-O-methyladenosine-3'-phosphate
  modified_base 6: mod_base = OTHER; note = 2'-deoxy-2'-fluoroguanosine-3'-phosphate
  modified_base 7: mod_base = OTHER; note = Adenosine-glycol nucleic acid (GNA), S-isomer
  modified_base 8: mod_base = OTHER; note = 2'-deoxy-2'-fluoroguanosine-3'-phosphate
  modified_base 9: mod_base = OTHER; note = 2'-O-methylcytidine-3'-phosphate
  modified_base 10: mod_base = OTHER; note = 2'-deoxy-2'-fluoroadenosine-3'-phosphate
  modified_base 11: mod_base = OTHER; note = 2'-O-methyladenosine-3'-phosphate
  modified_base 12: mod_base = OTHER; note = 2'-O-methylguanosine-3'-phosphate
  modified_base 13: mod_base = OTHER; note = 2'-O-methyladenosine-3'-phosphate
  modified_base 14: mod_base = OTHER; note = 2'-deoxy-2'-fluoroadenosine-3'-phosphate
  modified_base 15: mod_base = OTHER; note = 2'-O-methylcytidine-3'-phosphate
  modified_base 16: mod_base = OTHER; note = 2'-deoxy-2'-fluoroadenosine-3'-phosphate
  modified_base 17: mod_base = OTHER; note = 2'-O-methylcytidine-3'-phosphate
  modified_base 18: mod_base = OTHER; note = 2'-deoxy-2'-fluorouridine-3'-phosphate
  modified_base 19: mod_base = OTHER; note = 2'-O-methylguanosine-3'-phosphate
  modified_base 20: mod_base = OTHER; note = 2'-deoxy-2'-fluorouridine-3'-phosphate
  modified_base 21: mod_base = OTHER; note = 2'-O-methyluridine-3'-phosphorothioate
  modified_base 22: mod_base = OTHER; note = 2'-O-methyluridine-3'-phosphorothioate
  modified_base 23: mod_base = OTHER; note = 2'-O-methyluridine
ttatagagcaagaacactgtttt

SEQ ID NO: 456 - RNA, 23 nt, synthetic construct
  source 1..23: mol_type = other RNA
  modified_base 1: mod_base = OTHER; note = 2'-O-methyluridine-3'-phosphorothioate
  modified_base 2: mod_base = OTHER; note = Thymidine-glycol nucleic acid (GNA), S-Isomer phosphorothioate
  modified_base 3: mod_base = OTHER; note = 2'-O-methyladenosine-3'-phosphate
  modified_base 4: mod_base = OTHER; note = 2'-deoxy-2'-fluorouridine-3'-phosphate
  modified_base 5: mod_base = OTHER; note = 2'-O-methyladenosine-3'-phosphate
  modified_base 6: mod_base = OTHER; note = 2'-deoxy-2'-fluoroguanosine-3'-phosphate
  modified_base 7: mod_base = OTHER; note = 2'-O-methyladenosine-3'-phosphate
  modified_base 8: mod_base = OTHER; note = 2'-deoxy-2'-fluoroguanosine-3'-phosphate
  modified_base 9: mod_base = OTHER; note = 2'-O-methylcytidine-3'-phosphate
  modified_base 10: mod_base = OTHER; note = 2'-deoxy-2'-fluoroadenosine-3'-phosphate
  modified_base 11: mod_base = OTHER; note = 2'-O-methyladenosine-3'-phosphate
  modified_base 12: mod_base = OTHER; note = 2'-O-methylguanosine-3'-phosphate
  modified_base 13: mod_base = OTHER; note = 2'-O-methyladenosine-3'-phosphate
  modified_base 14: mod_base = OTHER; note = 2'-deoxy-2'-fluoroadenosine-3'-phosphate
  modified_base 15: mod_base = OTHER; note = 2'-O-methylcytidine-3'-phosphate
  modified_base 16: mod_base = OTHER; note = 2'-deoxy-2'-fluoroadenosine-3'-phosphate
  modified_base 17: mod_base = OTHER; note = 2'-O-methylcytidine-3'-phosphate
  modified_base 18: mod_base = OTHER; note = 2'-deoxy-2'-fluorouridine-3'-phosphate
  modified_base 19: mod_base = OTHER; note = 2'-O-methylguanosine-3'-phosphate
  modified_base 20: mod_base = OTHER; note = 2'-deoxy-2'-fluorouridine-3'-phosphate
  modified_base 21: mod_base = OTHER; note = 2'-O-methyluridine-3'-phosphorothioate
  modified_base 22: mod_base = OTHER; note = 2'-O-methyluridine-3'-phosphorothioate
  modified_base 23: mod_base = OTHER; note = 2'-O-methyluridine
ttatagagcaagaacactgtttt

We claim:

1. A double-stranded RNA (dsRNA) agent capable of inhibiting the expression of a target gene, comprising a sense strand and an antisense strand complementary to at least one portion of a mRNA of the target gene, each strand having 14 to 40 nucleotides and forming a duplex region of 14 to 40 base pairs, wherein
   the antisense strand comprises 2'-fluoro modifications only at positions 2, 6, 14, and 16 of the antisense strand, counting from the 5'-end of the antisense strand; and
   each nucleotide of the antisense strand is independently modified with a modification selected from the group consisting of an acyclic nucleotide, LNA, HNA, CeNA, 2'-methoxyethyl, 2'-O-methyl, 2'-O-allyl, 2'-C-allyl, 2'-deoxy, 2'-fluoro, 2'-O-N-methylacetamido (2'-O-NMA), a 2'-O-dimethylaminoethoxyethyl (2'-O-DMAEOE), 2'-O-aminopropyl (2'-O-AP), and 2'-ara-F.

2. The dsRNA agent of claim 1, wherein each end of the antisense strand comprises one or more phosphorothioate or methylphosphonate internucleotide linkage modifications within the five terminal nucleotides of each end.

3. The dsRNA agent of claim 1, wherein the dsRNA agent comprises one overhang region containing one or more overhang nucleotides, and one or more phosphorothioate or methylphosphonate internucleotide linkage among the one or more overhang nucleotides or between an overhang nucleotide and a terminal paired nucleotide within the duplex region.

4. The dsRNA agent of claim 3, wherein the dsRNA agent comprises a phosphorothioate or methylphosphonate internucleotide linkage between an overhang nucleotide and a terminal paired nucleotide within the duplex region.

5. The dsRNA agent of claim 3, wherein the overhang region consists of two nucleotides and the dsRNA agent comprises two phosphorothioate internucleotide linkages between the terminal three nucleotides, in which two of the three nucleotides are the overhang nucleotides, and the third is a paired nucleotide next to the overhang nucleotide.

6. The dsRNA agent of claim 5, wherein the terminal three nucleotides are at the 3'-end of the antisense strand.

7. The dsRNA agent of claim 1, wherein the antisense strand comprises two phosphorothioate internucleotide linkage modifications at positions 1 and 2 and two phosphorothioate internucleotide linkage modifications within positions 18-23 of the antisense strand, counting from the 5'-end of the antisense strand.

8. The dsRNA agent of claim 1, wherein each of the sense and antisense strands comprises 15-30 nucleotides.

9. The dsRNA agent of claim 1, wherein the sense strand has 19-22 nucleotides, the antisense strand has 19-25 nucleotides, and the duplex region is 19-21 base pairs.

10. The dsRNA agent of claim 1, wherein the sense strand has 21 nucleotides, and the antisense strand has 23 nucleotides.

11. The dsRNA agent of claim 1, wherein the dsRNA agent has a 3' overhang at the 3'-end of the antisense strand, and a blunt end at the 5'-end of the antisense strand.

12. The dsRNA agent of claim 1, wherein the dsRNA agent has two blunt ends at both ends of the antisense strand.

13. The dsRNA agent of claim 1, wherein at least one of the first, second, and third base pair from the 5'-end of the antisense strand is an AU base pair.

14. The dsRNA agent of claim 1, wherein each nucleotide of the antisense strand is independently modified with a 2'-O-Methyl or 2'-fluoro modification.

15. The dsRNA agent of claim 14, wherein each end of the antisense strand comprises one or more phosphorothioate or methylphosphonate internucleotide linkage modifications within the five terminal nucleotides of each end.

16. The dsRNA agent of claim 14, wherein the dsRNA agent comprises one overhang region containing one or more overhang nucleotides, and one or more phosphorothioate or methylphosphonate internucleotide linkage among the one or more overhang nucleotides or between an overhang nucleotide and a terminal paired nucleotide within the duplex region.

17. The dsRNA agent of claim 16, wherein the dsRNA agent comprises a phosphorothioate or methylphosphonate internucleotide linkage between an overhang nucleotide and a terminal paired nucleotide of the duplex region.

18. The dsRNA agent of claim 14, wherein the overhang region consists of two nucleotides and the dsRNA agent comprises two phosphorothioate internucleotide linkages between the terminal three nucleotides, in which two of the three nucleotides are the overhang nucleotides, and the third is a paired nucleotide next to the overhang nucleotide.

19. The dsRNA agent of claim 18, wherein the terminal three nucleotides are at the 3'-end of the antisense strand.

20. The dsRNA agent of claim 14, wherein the antisense strand comprises two phosphorothioate internucleotide linkage modifications at positions 1 and 2 and two phosphorothioate internucleotide linkage modifications within positions 18-23 of the antisense strand, counting from the 5'-end of the antisense strand.

21. The dsRNA agent of claim 1, wherein the antisense strand comprises a 5'-vinyl phosphonate (VP) at the 5'-end of the strand.

22. The dsRNA agent of claim 1, further comprising at least one ASGPR ligand.

23. The dsRNA agent of claim 22, wherein the ASGPR ligand is one or more GalNAc derivatives attached through a bivalent or trivalent branched linker.

24. The dsRNA agent of claim 22, wherein the ASGPR ligand is attached to the 5' end or 3' end of the sense strand.

25. A pharmaceutical composition comprising the dsRNA agent according to claim 1, in combination with a pharmaceutically acceptable carrier or excipient.

* * * * *